(12) United States Patent
Cao et al.

(10) Patent No.: US 12,409,177 B2
(45) Date of Patent: Sep. 9, 2025

(54) FGFR INHIBITORS FOR THE TREATMENT OF CANCER

(71) Applicant: BridGene Biosciences, Inc., Sunnyvale, CA (US)

(72) Inventors: Ping Cao, Sunnyvale, CA (US); Chao Zhang, Sunnyvale, CA (US); Michael J. Bishop, Sunnyvale, CA (US)

(73) Assignee: BridGene Biosciences, Inc., Sunnyvale, CA (US)

(*) Notice: Subject to any disclaimer, the term of this patent is extended or adjusted under 35 U.S.C. 154(b) by 949 days.

(21) Appl. No.: 17/430,621

(22) PCT Filed: Feb. 14, 2020

(86) PCT No.: PCT/US2020/018356
§ 371 (c)(1),
(2) Date: Aug. 12, 2021

(87) PCT Pub. No.: WO2020/168237
PCT Pub. Date: Aug. 20, 2020

(65) Prior Publication Data
US 2022/0218703 A1 Jul. 14, 2022

Related U.S. Application Data

(60) Provisional application No. 62/805,854, filed on Feb. 14, 2019.

(51) Int. Cl.
*A61K 31/506* (2006.01)
*A61K 45/06* (2006.01)
(Continued)

(52) U.S. Cl.
CPC ............ *A61K 31/506* (2013.01); *A61K 45/06* (2013.01); *C07D 401/04* (2013.01); *C07D 401/14* (2013.01); *C07D 405/14* (2013.01)

(58) Field of Classification Search
CPC .... A61K 31/506; A61K 45/06; C07D 401/04; C07D 401/14; C07D 405/14; A61P 35/00
See application file for complete search history.

(56) References Cited

U.S. PATENT DOCUMENTS 4,118,571 A  10/1978  Lesher et al.
7,880,000 B2  2/2011  Geuns-Meyer et al.
(Continued)

FOREIGN PATENT DOCUMENTS

CN  103596951 A  2/2014
GB  0121825  10/2001
(Continued)

OTHER PUBLICATIONS

Barillari et al., "Classical Bioisosteres", Bioisosteres in Medicinal Chemistry Ch. 2, Ed. Brown, Wiley-VCH Verlag GmbH & Co., pp. 15-29 (Year: 2012).*
CN Office Action in Chinese Application No. 2020800146914, dated May 5, 2023, 19 pages (with English translation).
Unkown, "Virtual Screening of Targeted FGFR4 Inhibitors and Theoretical Computational Study of Their Selective Mechanisms," China Master's Thesis Full Text Database Database (Master) Medicine and Health Science and Technology Series, May 2018, 64 pages (with English abstract).
(Continued)

*Primary Examiner* — Jeffrey S Lundgren
*Assistant Examiner* — Alexander K. Showalter
(74) *Attorney, Agent, or Firm* — Clark & Elbing LLP

(57) ABSTRACT

The disclosure provides novel FGFR inhibitors based on the pyridinylpyrimidine. The disclosure includes inhibitors with broad inhibitory activity against all FGFR isoforms, and inhibitors with selective inhibition against FGFR4. These novel pyridinylpyrimidine-based FGFR inhibitors, or their derivatives, have strong potential to be used to treat cancer.

12 Claims, 3 Drawing Sheets

Specification includes a Sequence Listing.

(51) Int. Cl.
*A61P 35/00* (2006.01)
*C07D 401/04* (2006.01)
*C07D 401/14* (2006.01)
*C07D 405/14* (2006.01)

(56) References Cited

U.S. PATENT DOCUMENTS

| | | | |
|---|---|---|---|
| 8,476,434 | B2 | 7/2013 | Geuns-Meyer et al. |
| 2006/0009453 | A1 | 1/2006 | Geuns-Meyer et al. |
| 2007/0213325 | A1 | 9/2007 | Cee et al. |
| 2009/0069327 | A1* | 3/2009 | Ding .................. C07D 239/42 544/122 |
| 2011/0201602 | A1 | 8/2011 | Geuns-Meyer et al. |
| 2012/0035171 | A1 | 2/2012 | Saxty et al. |
| 2022/0048883 | A1* | 2/2022 | Zhang .................. A61P 35/00 |

FOREIGN PATENT DOCUMENTS

| | | |
|---|---|---|
| GB | 2 369 359 A | 5/2002 |
| JP | 2009525978 A | 7/2009 |
| JP | 2014512357 A | 5/2014 |
| WO | WO 2007/092531 A2 | 8/2007 |
| WO | WO 2011075620 A1 | 6/2011 |

OTHER PUBLICATIONS

Wei, "Exploration of the Mechanism by Which Fisetin Induces Apoptosis in Breast Cancer Cells and Inhibits Embryonic Development in Zebrafish by Acting on the FGFR4 Pathway", China Master's Thesis Full Text Database Database (Master) Medicine and Health Science and Technology Series, Jan. 2015, 77 pages (with English abstract).

EP Extended Search Report in European Application No. 20755723, dated Oct. 11, 2022, 9 pages.

Hari et al., "Conformation-Selective Inhibitors Reveal Differences in the Activation and Phosphate-Binding Loops of the Tyrosine Kinases Abl and Src", ACS Chemical Biology, Oct. 2013, 8(12):2734-2743.

Ranjitkar et al., "Affinity Reagents that Target a Specific Inactive Form of Protein Kinases", Chemistry & Biology, Feb. 2010, 17(2):195-206.

Ranjitkar et al. "Affinity-Based Probes Based on Type II Kinase Inhibitors," J Am Chem Soc. 134(46):19017-19025 (Nov. 2012) (21 pages).

* cited by examiner

```
                  Subdomain V

FGFR1    -IVEYASKGNLR-  SEQ ID NO: 57
FGFR2    -IVEYASKGNLR-  SEQ ID NO: 58
FGFR3    -LVEYAAKGNLR-  SEQ ID NO: 59
FGFR4    -IVECAAKGNLR-  SEQ ID NO: 60
```

FGFR INHIBITORS FOR THE TREATMENT OF CANCER

CROSS-REFERENCE TO RELATED APPLICATIONS

This application is a 35 USC § 371 National Stage application of International Application No. PCT/US2020/018356 filed Feb. 14, 2020, now pending; which claims the benefit under 35 USC § 119 (e) to U.S. Application Ser. No. 62/805,854 filed Feb. 14, 2019. The disclosure of each of the prior applications is considered part of and is incorporated by reference in the disclosure of this application.

INCORPORATION BY REFERENCE OF SEQUENCE LISTING

The material in the accompanying sequence listing is hereby incorporated by reference into this application. The accompanying sequence listing text file, named BRIDGE1100-1_ST25.txt, was created on Aug. 5, 2021 and is 1,084 kB in size. The file can be accessed using Microsoft Word on a computer that uses Windows OS.

FIELD

The present disclosure relates generally to novel fibroblast growth factor receptor (FGFR) inhibitors, and more specifically to the use of pyridinylpyrimidine-based FGFR4 specific inhibitors for the treatment of cancer.

BACKGROUND

The human family of fibroblast growth factor receptors (FGFRs) is composed of four receptor tyrosine kinases that bind 18 ligands called fibroblast growth factors (FGFs). The four members (FGFR1, FGFR2, FGFR3, and FGFR4) are highly conserved among each other and consist of extracellular ligand-binding domains, a transmembrane segment, and a cytoplasmic tyrosine kinase domain. Upon binding of ligands to the extracellular domains of FGFRs, the kinase domains are activated by autophosphorylation and then phosphorylate cytoplasmic substrates, triggering downstream signaling cascades that control cell growth and differentiation.

The FGFR signaling pathway is an important and validated target for cancer therapeutics since it plays a crucial role in tumor proliferation, angiogenesis, migration, and survival. Mutations and overexpression of FGFRs and their ligands have been reported in several cancers, such as breast, lung, bladder, prostate, and gastric. For instance, amplification of FGFR1 has been found in about 10% of breast cancers (predominantly in estrogen receptor positive diseases), in 10-20% of squamous non-small-cell lung cancer (NSCLC), ovarian cancer (~5%), and bladder cancer (3%). FGFR2 amplification has been detected in gastric (5-10%) and breast cancers (4% of triple negative cases), and mutations in FGFR2 occur in 12% of endometrial carcinomas. FGFR3 mutations were identified in about 70% of non-muscle-invasive bladder cancers and 10-20% of invasive high-grade bladder cancers. Amplification and activating mutations in FGFR4 have been described in 8% of rhabdomyosarcoma patients. In addition, many preclinical studies have reported FGFR4 overexpression in prostate, colon, and liver cancers.

A number of FGFR small-molecule inhibitors have been developed and evaluated in clinical trials for the treatment of cancers, but most of them are pan-FGFR inhibitors with promiscuous kinome activity, such as BGJ398 and LY-2874455. It has been found, from sequence analysis, that FGFR4 contains a cysteine (Cys552) located near the ATP-binding site, in the hinge region of the receptor, which is unique within the FGFR family and rare among other kinases. In fact, the first selective FGFR4 inhibitor, BLU9931, was discovered recently targeting this unique cysteine and exhibited very good specificity and significant antitumor activity against hepatocellular carcinoma in vivo. However, the potency and bioavailability of BLU9931 is suboptimal for clinical applications.

SUMMARY

Embodiments of the present disclosure include novel pyridinylpyrimidine-based compounds that are potent FGFR4 specific inhibitors. The FGFR4 specific inhibitors can be used as targeted therapies to treat cancer.

In some embodiments, the present disclosure provides a compound of Formula (I)

Formula (I)

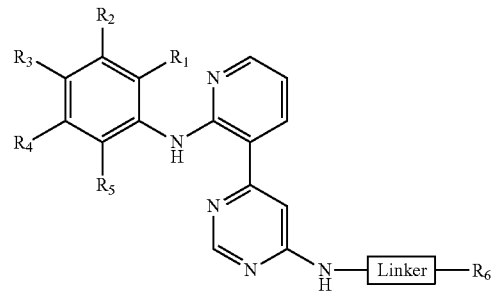

or an optically pure stereoisomer, solvate, or pharmaceutically acceptable salt thereof.

In some embodiments, each $R_1$, $R_2$, $R_3$, $R_4$, and $R_5$ can be independently H, F, Cl, Br, $C_{1-4}$ alkyl, cyclopropyl, $N_3$, $NH_2$, $NO_2$, $CF_3$, $OCF_3$, $OCHF_2$, or $OC_{1-4}$alkyl. In some embodiments, $R_6$ can be $(CH_2)_{0-5}CH{=}CH_2$, $(CH_2)_{0-5}C{\equiv}CH$, $NHCO(CH_2)_{0-5}CH{=}CH_2$, $NH(CH_2)_{0-5}CH{=}CH_2$, $OCO(CH_2)_{0-5}CH{=}CH_2$, $O(CH_2)_{0-5}CH{=}CH_2$, $NHCO(CH_2)_{0-5}C{\equiv}CH$, or $OCO(CH_2)_{0-5}C{\equiv}CH$.

In some embodiments, Linker can be selected from the group consisting of $C_{1-20}$alkyl, $COC_{1-20}$alkyl, $CO_2C_{1-20}$alkyl,

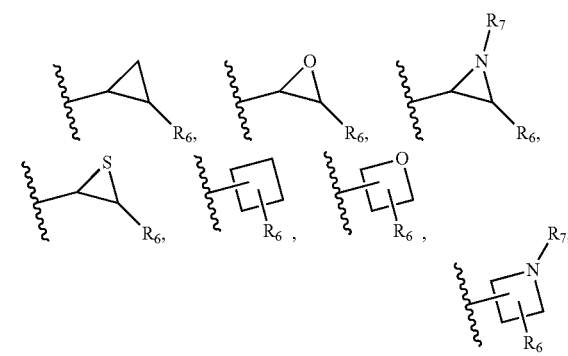

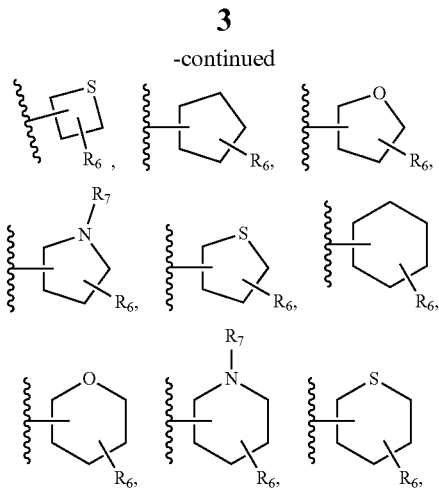

phenyl, naphthyl, anthracene,

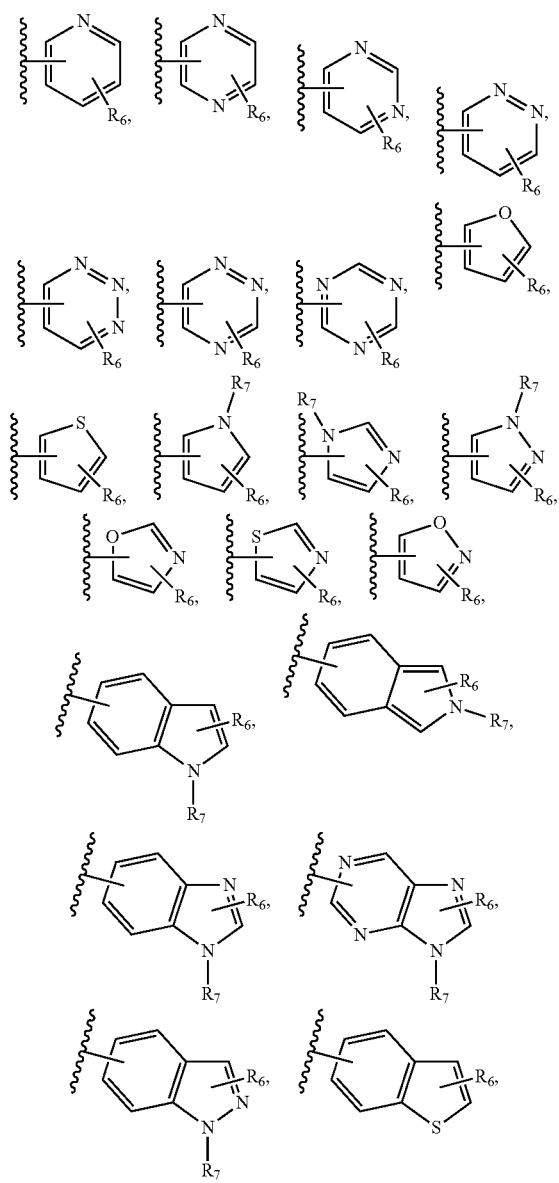

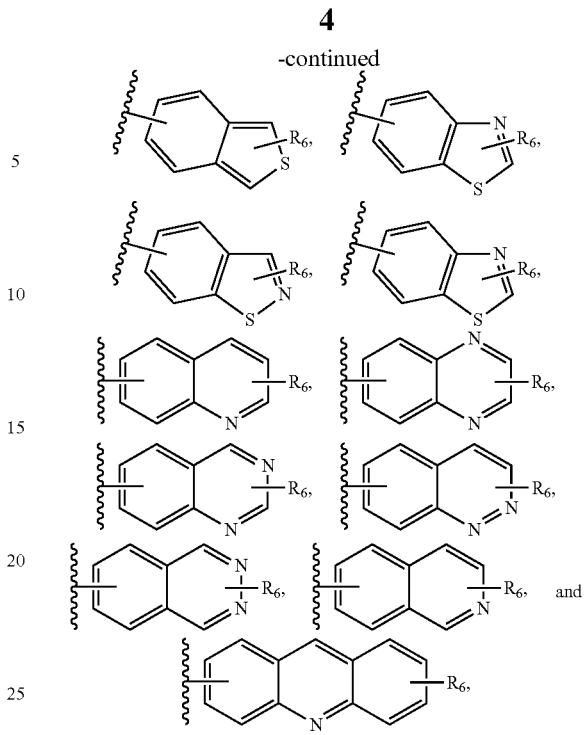

optionally substituted with one or more substituents selected from the group consisting of F, Cl, Br, $C_{1-4}$ alkyl, $CF_3$, $CHF_2$, $NO_2$, $-NR_7-(CH_2)_n-R_8$, $-CO\,NR_7-(CH_2)_n-R_8$, $-CO-(CH_2)_n-R_8$, $-OCO-(CH_2)_n-R_8$, and $-O-(CH_2)_n-R_8$.

In some embodiments, n can be an integer selected from 0 to 5. In some embodiments, $R_7$ can be selected from the group consisting of H, $C_{1-4}$ alkyl, and $COC_{1-4}$alkyl.

In some embodiments, $R_8$ can be selected from the group consisting of $C_{1-20}$ alkyl $COC_{1-20}$alkyl, $CO_2C_{1-20}$alkyl,

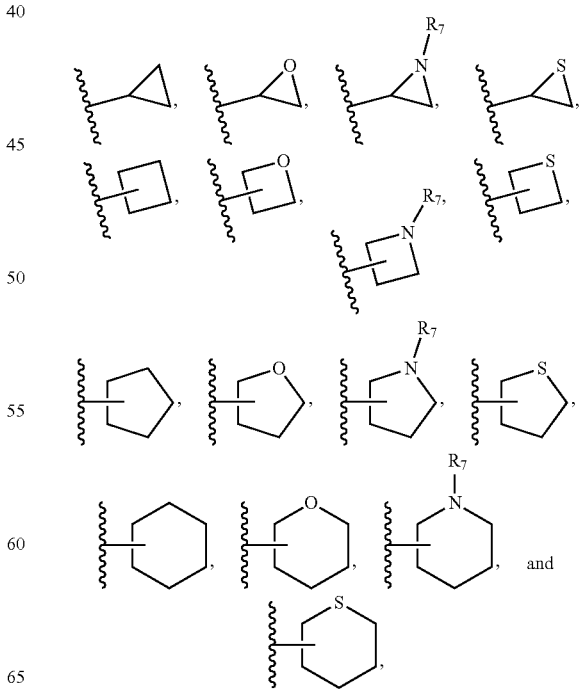

optionally substituted with one or more substituents selected from the group consisting of F, Cl, Br, $C_{1-4}$ alkyl, $CF_3$, $CHF_2$, and $NO_2$.

The present disclosure also provides a compound of Formula (II)

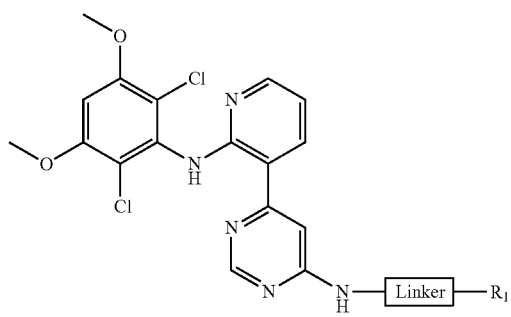

Formula (II)

or an optically pure stereoisomer, solvate, or pharmaceutically acceptable salt thereof.

In some embodiments, $R_1$ can be $(CH_2)_{0-5}CH=CH_2$, $(CH_2)_{0-5}C\equiv CH$, $NHCO(CH_2)_{0-5}CH=CH_2$, $NH(CH_2)_{0-5}CH=CH_2$, $OCO(CH_2)_{0-5}CH=CH_2$, $O(CH_2)_{0-5}CH=CH_2$, $NHCO(CH_2)_{0-5}C\equiv CH$, or $OCO(CH_2)_{0-5}C\equiv CH$.

Linker can be selected from the group consisting of $C_{1-20}$alkyl, $COC_{1-20}$alkyl, $CO_2C_{1-20}$alkyl,

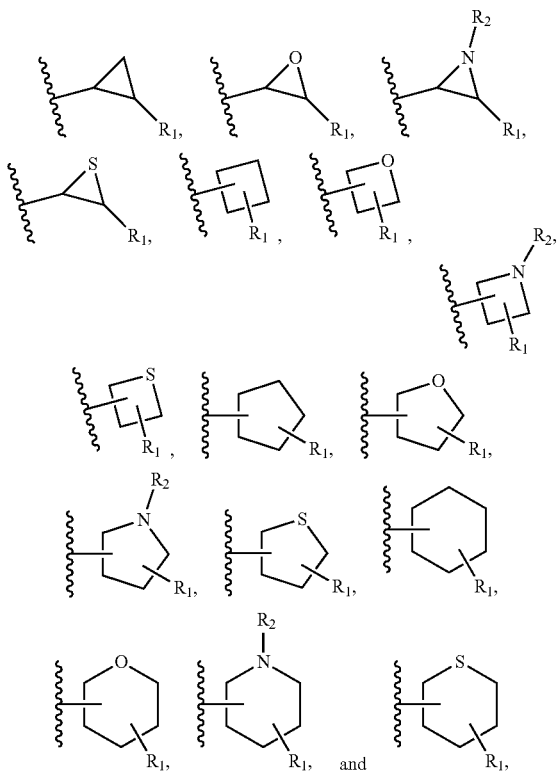

phenyl, naphthyl, anthracene,

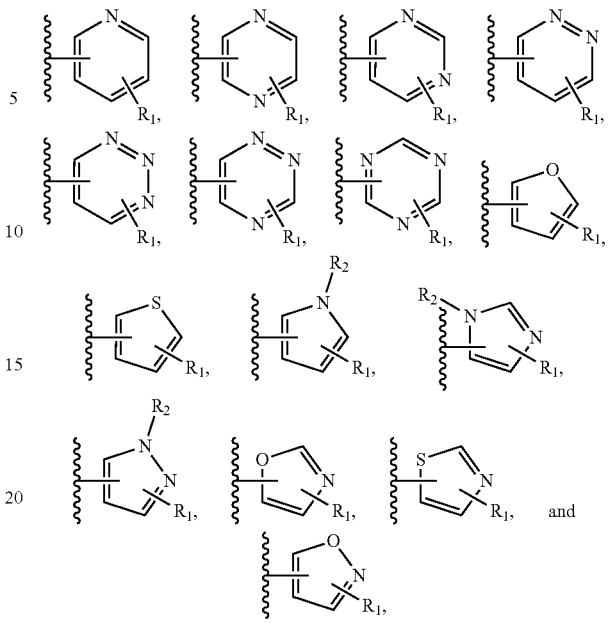

optionally substituted with one or more substituents selected from the group consisting of F, Cl, Br, $C_{1-4}$ alkyl, $CF_3$, $CHF_2$, $NO_2$, $-NR_2-(CH_2)_n-R_3$, $-CO\ NR_2-(CH_2)_n-R_3$, $-CO-(CH_2)_n-R_3$, $-OCO-(CH_2)_n-R_3$, and $-O-(CH_2)_n-R_3$.

In some embodiments, $R_2$ can be selected from the group consisting of H, $C_{1-4}$ alkyl, and $COC_{1-4}$alkyl. n is an integer selected from 0 to 5.

In some embodiments, $R_3$ can be selected from the group consisting of $C_{1-20}$ alkyl, $COC_{1-20}$alkyl, $CO_2C_{1-20}$alkyl,

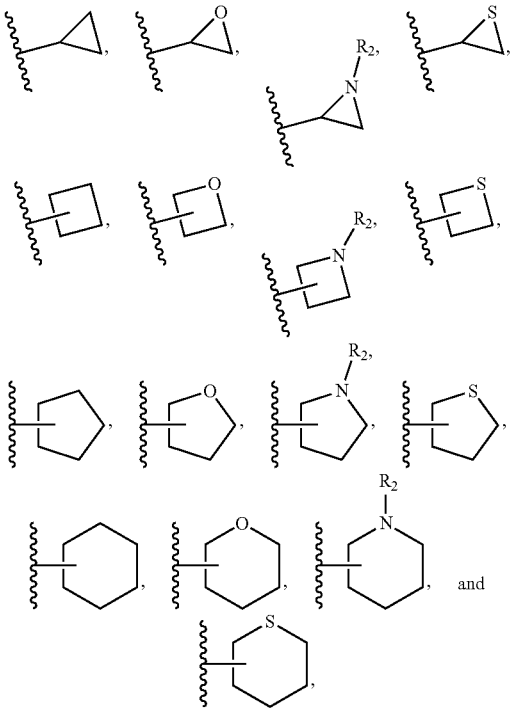

optionally substituted with one or more substituents selected from the group consisting of F, Cl, Br, $C_{1-4}$ alkyl, $CF_3$, $CHF_2$, and $NO_2$.

The present disclosure also provides a compound of Formula (III)

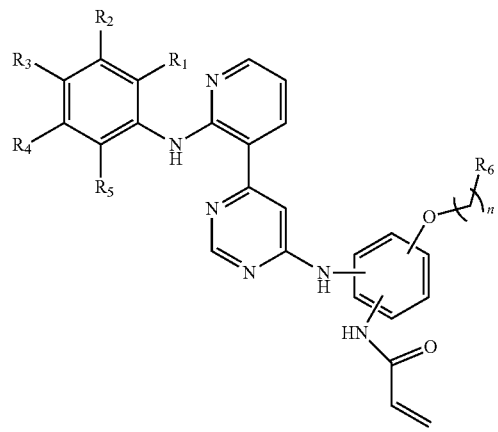

Formula (III)

or an optically pure stereoisomer, solvate, or pharmaceutically acceptable salt thereof.

In some embodiments, each $R_1$, $R_2$, $R_3$, $R_4$, and $R_5$ can be independently selected from the group consisting of H, F, Cl, Br, $C_{1-4}$ alkyl, cyclopropyl, $N_3$, $NH_2$, $NO_2$, $CF_3$, $OCF_3$, $OCHF_2$, and $OC_{1-4}$alkyl. n can be an integer selected from 0 to 5.

In some embodiments, $R_6$ can be selected from the group consisting of $C_{1-20}$ alkyl, $COC_{1-20}$alkyl, $CO_2C_{1-20}$alkyl,

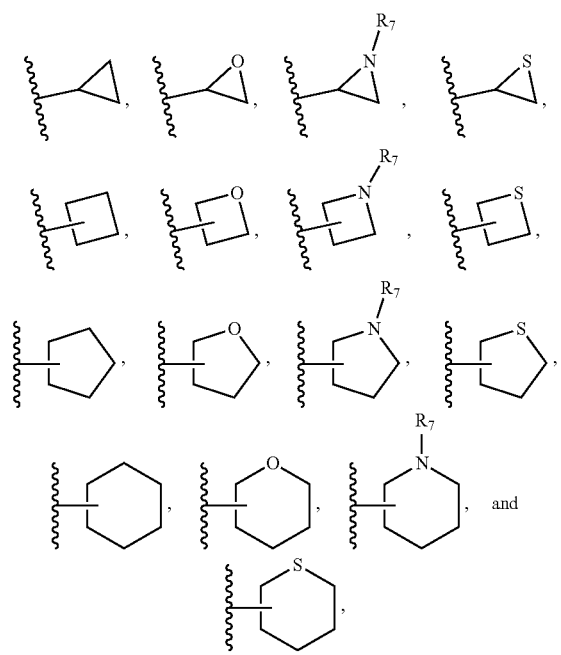

optionally substituted with one or more substituents selected from the group consisting of F, Cl, Br, $C_{1-4}$ alkyl, $CF_3$, $CHF_2$, and $NO_2$. $R_7$ can be selected from the group consisting of H, $C_{1-4}$ alkyl, and $COC_{1-4}$alkyl.

In some embodiments, the compound can selected from the group consisting of

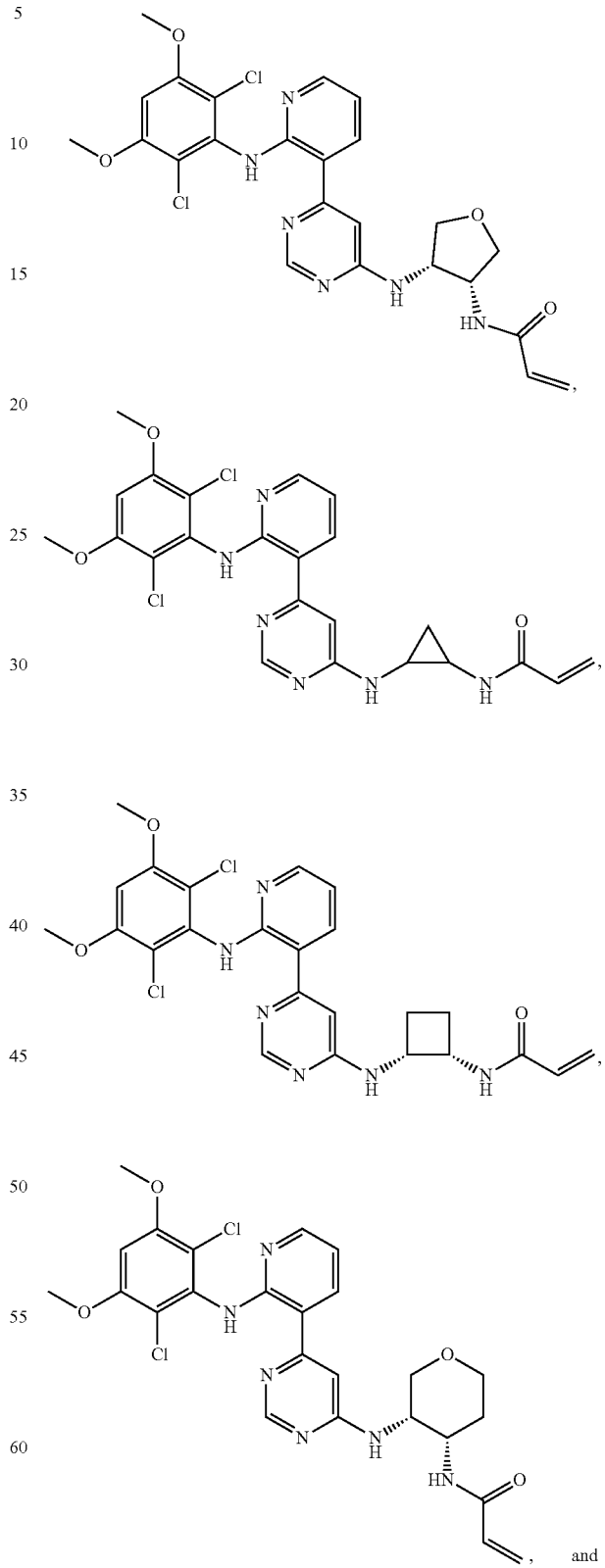

and

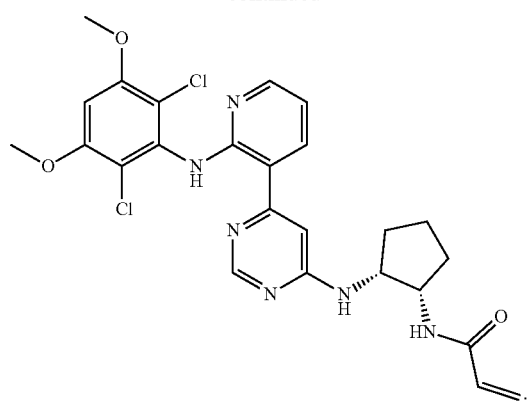 [SMILES: C=CC(=O)N[C@H]1CCC[C@H]1Nc1cc(-c2cccnc2Nc2c(Cl)c(OC)cc(OC)c2Cl)ncn1]
In some embodiments, the compound can be selected from the group consisting of
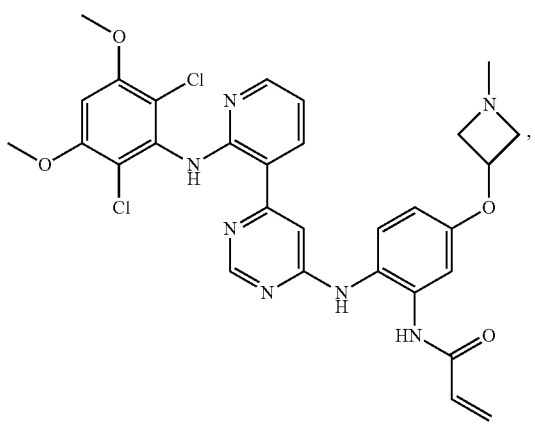
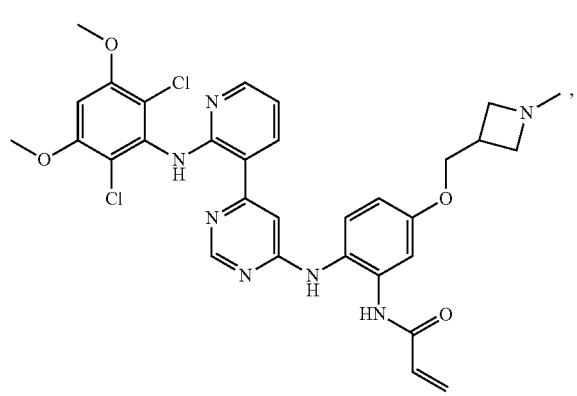
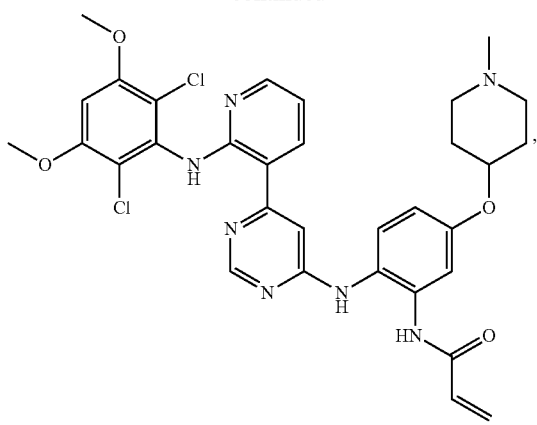
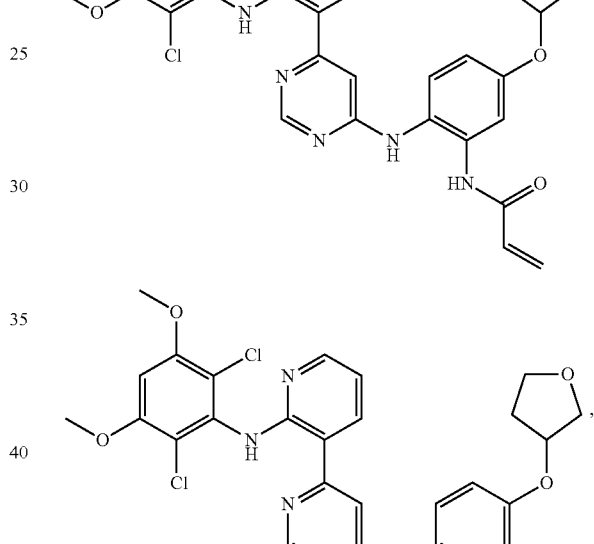
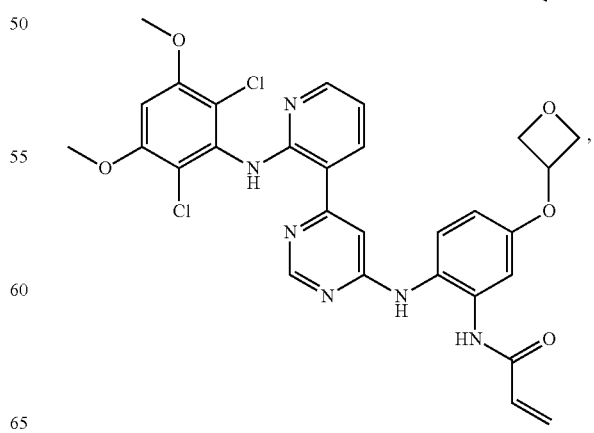

-continued

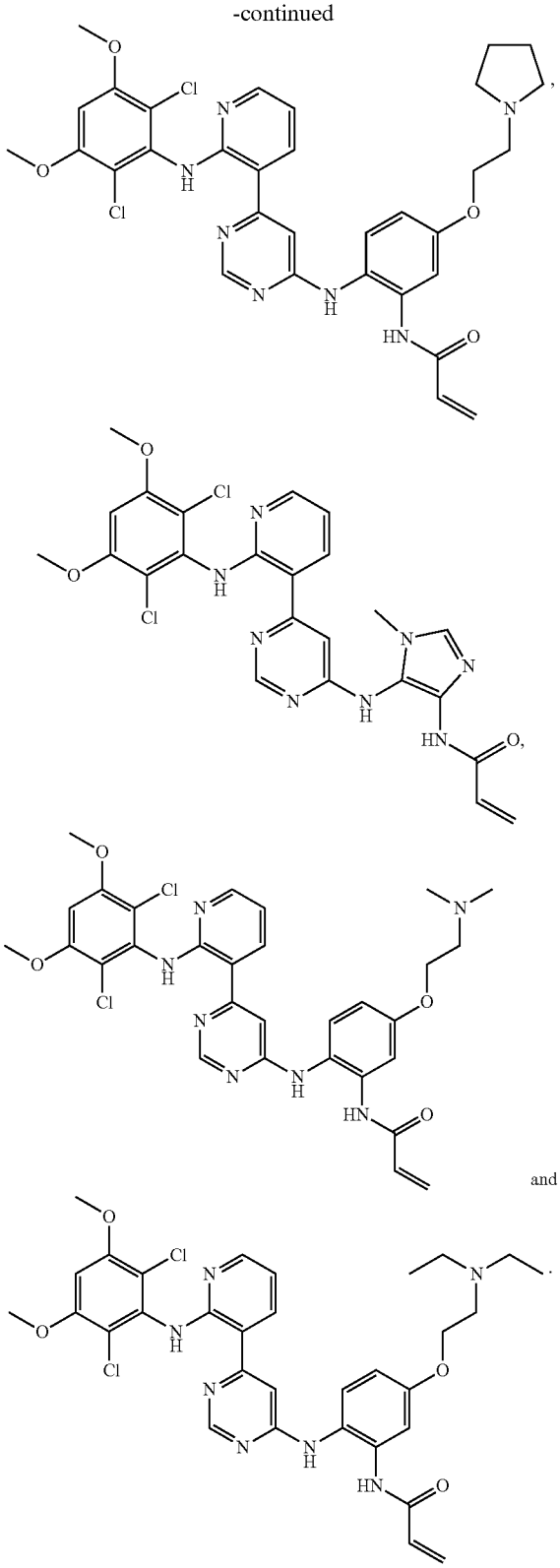

and

The present disclosure also provides a pharmaceutical formulation including the compound according to Formula (I), Formula (II), Formula (III), or an optically pure stereoisomer or pharmaceutically acceptable salt thereof. The present disclosure further provides a method for treating cancer in a subject including administering a compound with the structure of Formula (I), Formula (II), Formula (III), or an optically pure stereoisomer or pharmaceutically acceptable salt thereof to the subject. In some embodiments, the compound targets amino acid residue 484 of SEQ ID NO: 52, amino acid residue 512 of SEQ ID NO: 56, or amino acid residue 552 of SEQ ID NO: 50 or 54. The present disclosure also provides a method of inhibiting a kinase activity including contacting a cell with a compound with the structure of Formula (I), Formula (II), Formula (III), or an optically pure stereoisomer or pharmaceutically acceptable salt thereof. In some embodiments, the kinase can be Anaplastic lymphoma kinase (ALK), Epidermal growth factor receptor (EGFR), Ephrin type-3 receptor 3 (EPH-B3), Focal adhesion kinase (FAK), Fibroblast growth factor receptor 1 (FGFR1), Fibroblast growth factor receptor 2 (FGFR2), Fibroblast growth factor receptor 3 (FGFR3), Fibroblast growth factor receptor 4 (FGFR4), Mast/stem cell growth factor receptor (SCFR or KIT), Mitogen-activated protein kinase kinase 1 (MAP2K1 or MEK1), Hepatocyte growth factor receptor (HGFR or MET), Platelet-derived growth factor receptor alpha (PDGFRA), Platelet-derived growth factor receptor beta (PDGFRB), Proto-oncogene tyrosine kinase receptor (RET), Proto-oncogene tyrosine-protein kinase (ROS) or Tyrosine-protein kinase receptor (TYRO 3). The cell can be a cancer cell. The cancer cell can be a breast, lung, bladder, prostate, ovarian, endometrial, rhabdomyosarcoma, liver or gastric cancer cell.

Other features and advantages can become apparent from the following detailed drawings and description.

BRIEF DESCRIPTION OF THE DRAWINGS

In order to facilitate a full understanding of the present disclosure, reference is now made to the accompanying drawings, in which like elements are referenced with like numerals. These drawings should not be construed as limiting the present disclosure, but are intended to be illustrative only. The drawings are not necessarily to scale, or inclusive of all elements of a system, emphasis instead generally being placed upon illustrating the concepts, structures, and techniques sought to be protected herein.

DESCRIPTION

Figure 1:
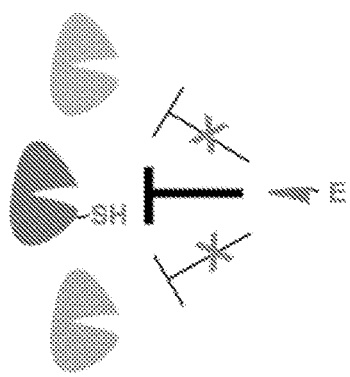
FIG. 1 is a schematic representation of FGFR kinases. A. Schematic representation of the selective inhibition of FGFRs by electrophilic inhibitors by covalently targeting a thiol group (SH) in the cysteine residue. B. Partial sequence alignment of FGFR kinases within the subdomain V highlighting the unique cysteine residue that FGFR4 contains near the ATP-binding site.

Disclosed herein is a class of chemical compounds as FGFR4-selective inhibitors. These small molecule inhibitors can be used as targeted therapies to treat cancer.

Fibroblast growth factor receptors (FGFRs) are highly conserved receptors consisting of extracellular ligand-binding domain, a transmembrane segment, and a cytoplasmic tyrosine kinase domain. The human FRFR family includes four members, FGFR1, FGFR2, FGFR3, and FGFR4, which can be bound by 18 different ligands called fibroblast growth factors (FGFs). Each receptor is composed of an extracellular domain, consisting of three immunoglobulin-like domain (IgI IgII, and IgIII) and an acid box, the IgII and IgIII domains constituting the FGF ligand-binding site; a transmembrane domain; and a tyrosine kinase cytoplasmic domain. FGFRs also contain hinge region (subdomain V), located near the ATP-binding site (SEQ ID NOs 57-60). FGFRs encoding mRNA are subjected to alternative splicing, giving rise to several protein-coding splice variants or isoforms (SEQ ID NOs: 1; 3; 5; 7; 9; 11; 13; 15; 17; 19; 21; 23; 25; 27; 29; 31; 33; 35; 37; 39; 41; 43; 45; 47; 49; 51; 53; and 55). As shown in Table 3, the human FGFR1 gene encodes 9 protein coding splice variants (SEQ ID Nos: 2; 4; 6; 8; 10; 12; 14; 16; and 18), the human FGFR2 gene encodes 11 protein coding splice variants (SEQ ID Nos: 20; 22; 24; 26; 28; 30; 32; 34; 36; 38; and 40), the human FGFR3 gene encodes four protein coding splice variants (SEQ ID Nos: 42; 44; 46; and 48), and the human FGFR4 gene encodes four protein coding splice variants (SEQ ID Nos: 50; 52; 54; and 56).

There are 18 members in the FGF family of ligands (FGF1-FGF10 and FGF16-FGF23). The binding of a ligand to the extracellular domain of a FGFR leads to receptor dimerization resulting in the activation of the tyrosine-kinase domain by auto-phosphorylation. Subsequently, an activated FGFR phosphorylates cytoplasmic substrates, such as FGFR substrate 2 (FRS2) and phosphlypase Cγ (PLCγ) triggering downstream signaling cascades. Activated FRS2 promotes the RAS-mitogen-activated protein kinase (MAPK) or the phosphoinositide 3-kinase (PI3K)-AKT pathways that regulate cell proliferation, differentiation and survival. On the other hand, the activation of PLCγ lead to calcium release and regulates events that mediate cell motility.

Deregulation of FGFR signaling has been linked to oncogenesis through several mechanisms including activating mutations, gene amplification or changes in post-transcriptional processing, and translocation, leading to constitutive activation of the receptor.

Specifically, FGFR4 amplification and activating mutations have been described in patients with rhabdomyosarcoma, and FGFR4 overexpression have been linked to prostate, colon, breast and liver cancers. FGFR4 differs from the other FGFRs by the presence of a cysteine in the hinge region, which is unique within the FGFR family and rare among other kinases. Depending on the isoform, the cysteine is located at different positions: Cys484 of SEQ ID NO: 52, Cys512 of SEQ ID NO: 56, or Cys552 of SEQ ID NO: 50 or 54. This unique cysteine can be targeted for the design of FGFR4 specific inhibitors exhibiting very good specificity.

As used herein, the term "FGFR inhibitor" or "FGFRi" refers to any compound capable of inhibiting the enzymatic of FGFR, including its own auto-phosphorylation and the kinase activity. Such inhibitors efficiently inhibit FGFRs, and are said to "inhibit", "decrease", or "reduce" the biological activity of FGFRs. The FGFR inhibitors of the disclosure can be "pan-inhibitor" and present a broad efficiency at inhibiting one or more of FGFR1-FGFR4, or present a specific efficiency at inhibiting only one FGFR, FGFR4 for example.

The efficiency of a compound can be referred to by its IC50 value. The "IC50" is the half-maximal inhibitory concentration (IC50) of a compound. As used herein, the IC50 of a FGFRi refers to the concentration of inhibitor which is sufficient to induce the inhibition of the enzymatic activity of FGFR halfway between the baseline and maximum after a specified exposure time. The IC50 value of the present disclosure specifically refers to the concentration of FGFR inhibitor which is sufficient to induce the inhibition of one or more FGFRs, i.e. FGFR1, FGFR2, FGFR3 and/or FGFR4.

In some embodiments, the present disclosure provides a compound of Formula (I)

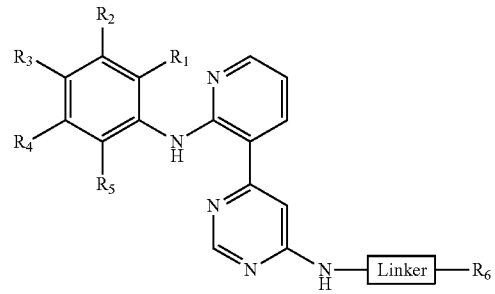

Formula (I)

or an optically pure stereoisomer, solvate, or pharmaceutically acceptable salt thereof.

In some embodiments, each $R_1$, $R_2$, $R_3$, $R_4$, and $R_5$ can be independently H, F, Cl, Br, $C_{1-4}$ alkyl, cyclopropyl, $N_3$, $NH_2$, $NO_2$, $CF_3$, $OCF_3$, $OCHF_2$, or $OC_{1-4}$alkyl. In some embodiments, $R_6$ can be $(CH_2)_{0-5}CH{=}CH_2$, $(CH_2)_{0-5}C{\equiv}CH$, $NHCO(CH_2)_{0-5}CH{=}CH_2$, $NH(CH_2)_{0-5}CH{=}CH_2$, $OCO(CH_2)_{0-5}CH{=}CH_2$, $O(CH_2)_{0-5}CH{=}CH_2$, $NHCO(CH_2)_{0-5}C{\equiv}CH$, or $OCO(CH_2)_{0-5}C{\equiv}CH$.

In some embodiments, Linker can be selected from the group consisting of $C_{1-20}$ alkyl, $COC_{1-20}$alkyl, $CO_2C_{1-20}$alkyl,

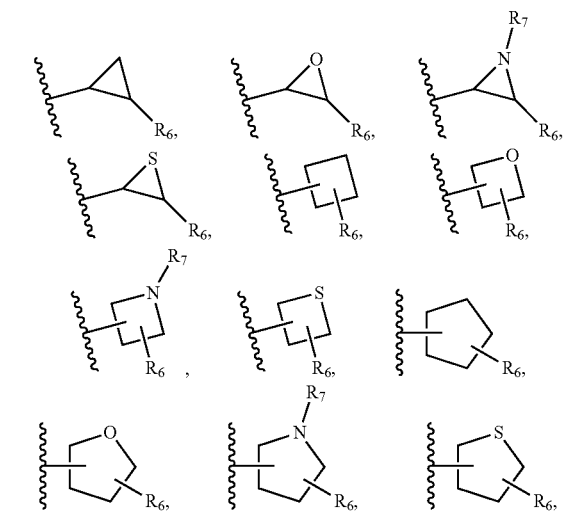

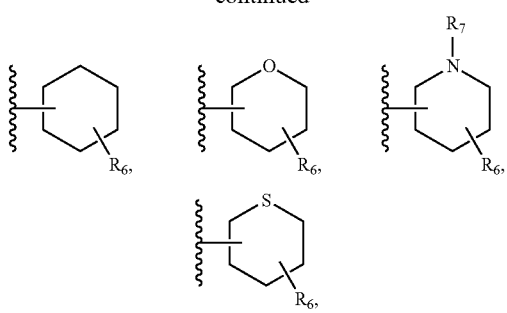

phenyl, naphthyl, anthracene,

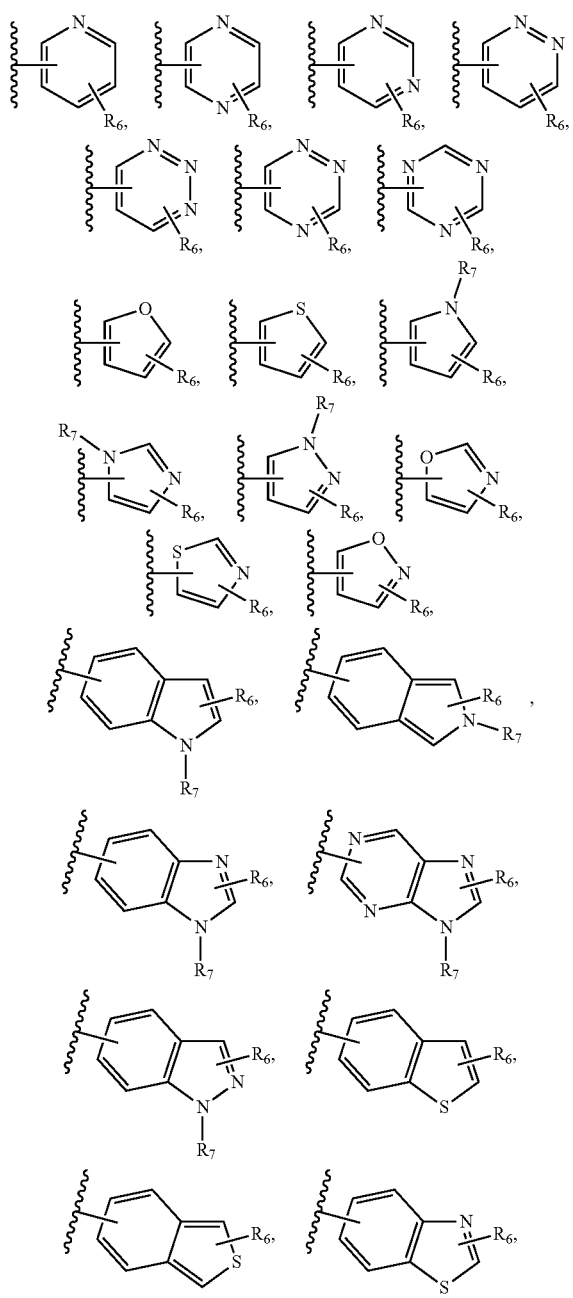

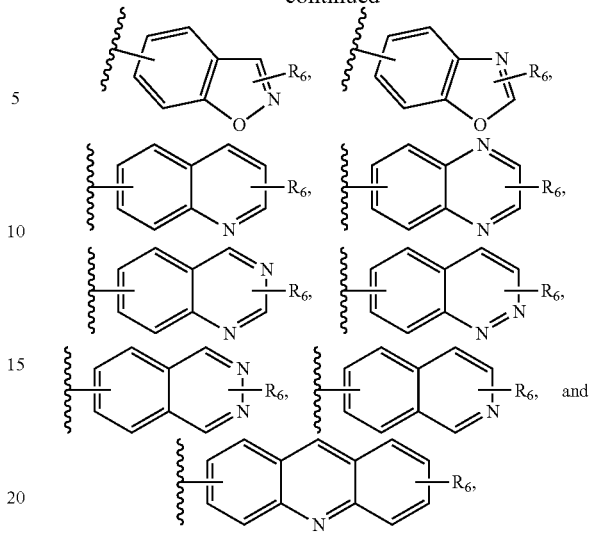

optionally substituted with one or more substituents selected from the group consisting of F, Cl, Br, $C_{1-4}$ alkyl, $CF_3$, $CHF_2$, $NO_2$, $-NR_7-(CH_2)_n-R_8$, $-CO-NR_7-(CH_2)_n-R_8$, $-CO-(CH_2)_n-R_8$, $-OCO-(CH_2)_n-R_8$, and $-O-(CH_2)_n-R_8$. The number of the optional substituents can be an integer selected from 0 to 4.

In some embodiments, n can be an integer selected from 0 to 5. In some embodiments, $R_7$ can be selected from the group consisting of H, $C_{1-4}$ alkyl, and $COC_{1-4}$alkyl.

In some embodiments, $R_8$ can be selected from the group consisting of $C_{1-20}$ alkyl, $COC_{1-20}$alkyl, $CO_2C_{1-20}$alkyl,

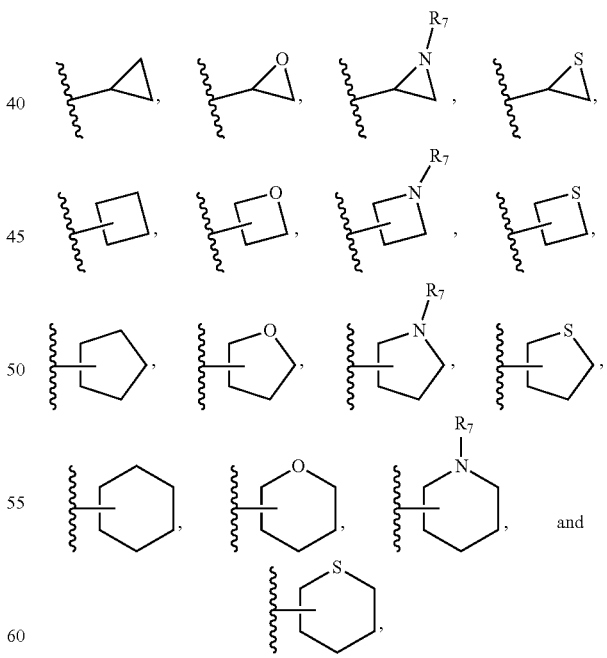

optionally substituted with one or more substituents selected from the group consisting of F, Cl, Br, $C_{1-4}$ alkyl, $CF_3$, $CHF_2$, and $NO_2$.

In some embodiments, $R_1$ and $R_5$ are Cl, $R_2$ and $R_4$ are OMe, and $R_3$ is H.

The present disclosure also provides a compound of Formula (II)

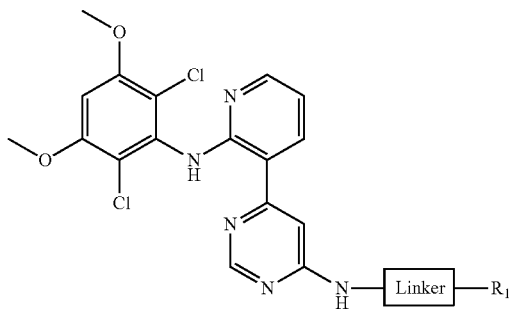

Formula (II)

or an optically pure stereoisomer, solvate, or pharmaceutically acceptable salt thereof.

In some embodiments, $R_1$ can be $(CH_2)_{0-5}CH=CH_2$, $(CH_2)_{0-5}C\equiv CH$, $NHCO(CH_2)_{0-5}CH=CH_2$, $NH(CH_2)_{0-5}CH=CH_2$, $OCO(CH_2)_{0-5}CH=CH_2$, $O(CH_2)_{0-5}CH=CH_2$, $NHCO(CH_2)_{0-5}C\equiv CH$, or $OCO(CH_2)_{0-5}C\equiv CH$.

Linker can be selected from the group consisting of $C_{1-20}$alkyl, $COC_{1-20}$alkyl, $CO_2C_{1-20}$alkyl,

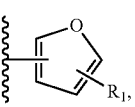
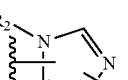
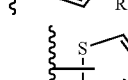
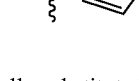
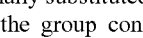
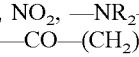
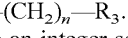
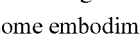
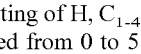
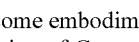
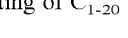

phenyl, naphthyl, anthracene,

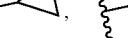
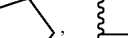

optionally substituted with one or more substituents selected from the group consisting of F, Cl, Br, $C_{1-4}$ alkyl, $CF_3$, $CHF_2$, $NO_2$, $-NR_2-(CH_2)_n-R_3$, $-CO\ NR_2-(CH_2)_n-R_3$, $-CO-(CH_2)_n-R_3$, $-OCO-(CH_2)_n-R_3$, and $-O-(CH_2)_n-R_3$. The number of the optional substituents can be an integer selected from 0 to 4.

In some embodiments, $R_2$ can be selected from the group consisting of H, $C_{1-4}$ alkyl, and $COC_{1-4}$alkyl. n is an integer selected from 0 to 5.

In some embodiments, $R_3$ can be selected from the group consisting of $C_{1-20}$ alkyl, $COC_{1-20}$alkyl, $CO_2C_{1-20}$alkyl,

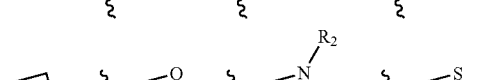
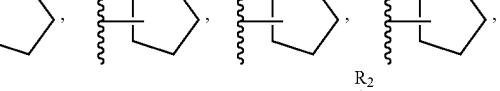
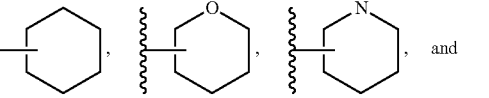

optionally substituted with one or more substituents selected from the group consisting of F, Cl, Br, $C_{1-4}$ alkyl, $CF_3$, $CHF_2$, and $NO_2$.

The present disclosure also provides a compound of Formula (III)

Formula (III)

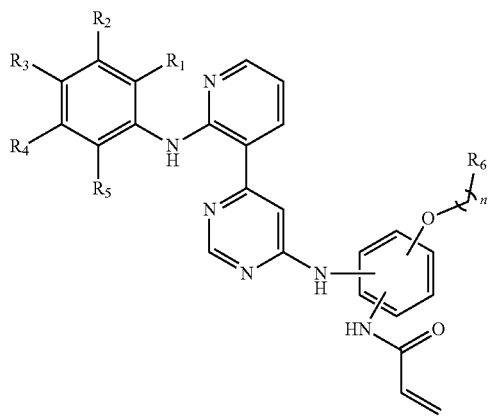

or an optically pure stereoisomer, solvate or pharmaceutically acceptable salt thereof.

In some embodiments, each $R_1$, $R_2$, $R_3$, $R_4$, and $R_5$ can be independently selected from the group consisting of H, F, Cl, Br, $C_{1-4}$ alkyl, cyclopropyl, $N_3$, $NH_2$, $NO_2$, $CF_3$, $OCF_3$, $OCHF_2$, and $OC_{1-4}$alkyl. n can be an integer selected from 0 to 5.

In some embodiments, $R_6$ can be selected from the group consisting of $C_{1-20}$ alkyl, $COC_{1-20}$alkyl, $CO_2C_{1-20}$alkyl,

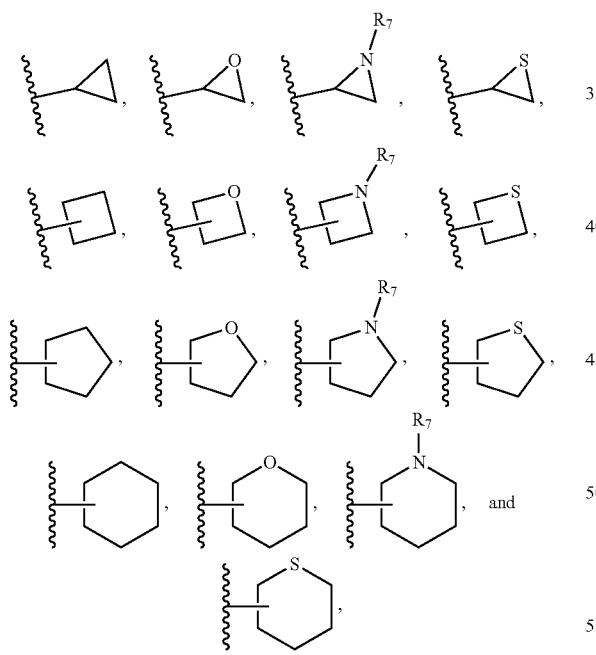

optionally substituted with one or more substituents selected from the group consisting of F, Cl, Br, $C_{1-4}$ alkyl, $CF_3$, $CHF_2$, and $NO_2$. $R_7$ can be selected from the group consisting of H, $C_{1-4}$ alkyl, and $COC_{1-4}$alkyl. The number of the optional substituents can be an integer selected from 0 to 4.

In some embodiments, $R_1$ and $R_5$ are Cl, $R_2$ and $R_4$ are OMe, and $R_3$ is H.

In some embodiments, the present disclosure provides a compound of Formula (IV)

Formula (IV)

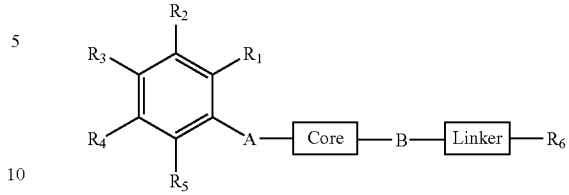

or an optically pure stereoisomer, solvate, or pharmaceutically acceptable salt thereof.

In some embodiments, each $R_1$, $R_2$, $R_3$, $R_4$, and $R_5$ can be independently H, F, Cl, Br, $C_{1-4}$ alkyl, cyclopropyl, $N_3$, $NH_2$, $NO_2$, $CF_3$, $OCF_3$, $OCHF_2$, or $OC_{1-4}$alkyl. In some embodiments, $R_6$ can be $(CH_2)_{0-5}CH=CH_2$, $(CH_2)_{0-5}C\equiv CH$, $NHCO(CH_2)_{0-5}CH=CH_2$, $NH(CH_2)_{0-5}CH=CH_2$, $OCO(CH_2)_{0-5}CH=CH_2$, $O(CH_2)_{0-5}CH=CH_2$, $NHCO(CH_2)_{0-5}C\equiv CH$, or $OCO(CH_2)_{0-5}C\equiv CH$.

In some embodiments, each A and B can be independently $NR_7$, $CONR_7$, O, CO, or OCO.

In some embodiments, Core can be selected from the group consisting of

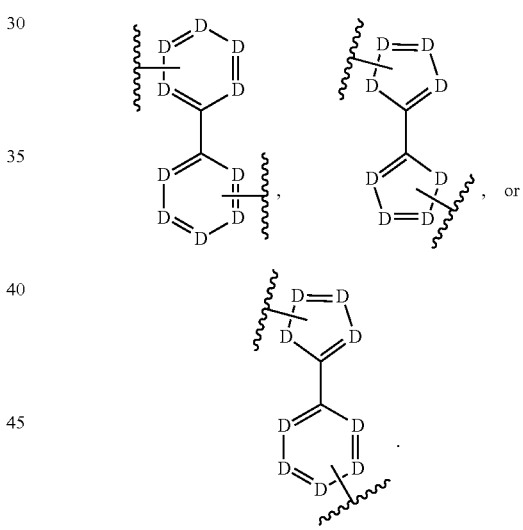

Each D can be independently N or CH.

In some embodiments, Linker can be selected from the group consisting of $C_{1-20}$ alkyl, $COC_{1-20}$alkyl, $CO_2C_{1-20}$alkyl,

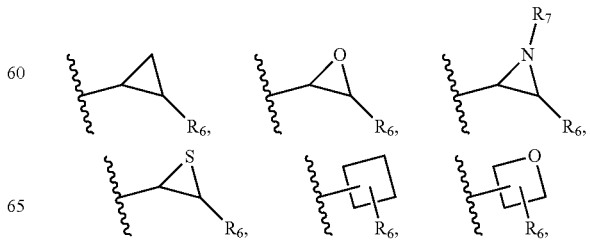

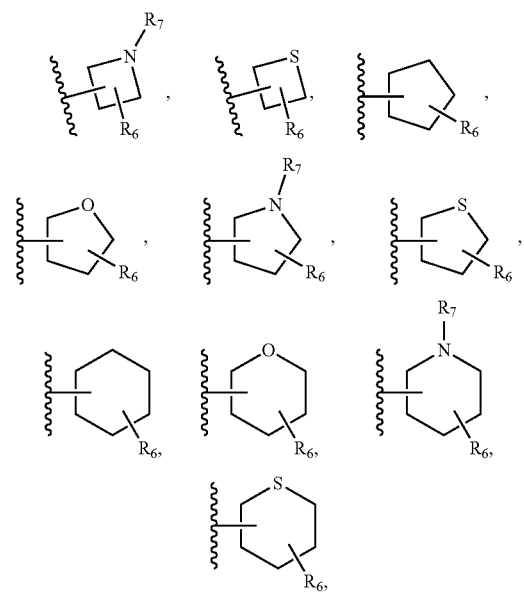

phenyl, naphthyl, anthracene,

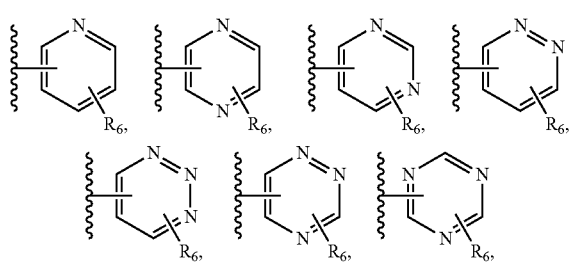

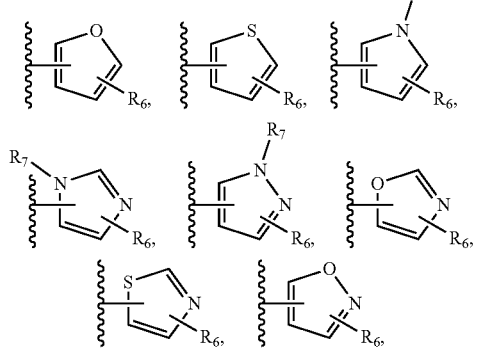

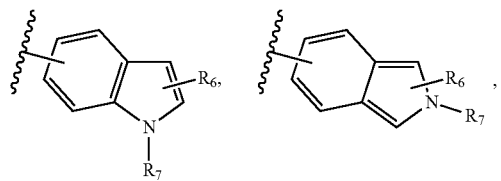

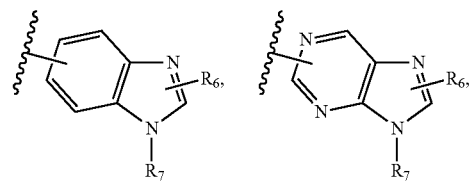

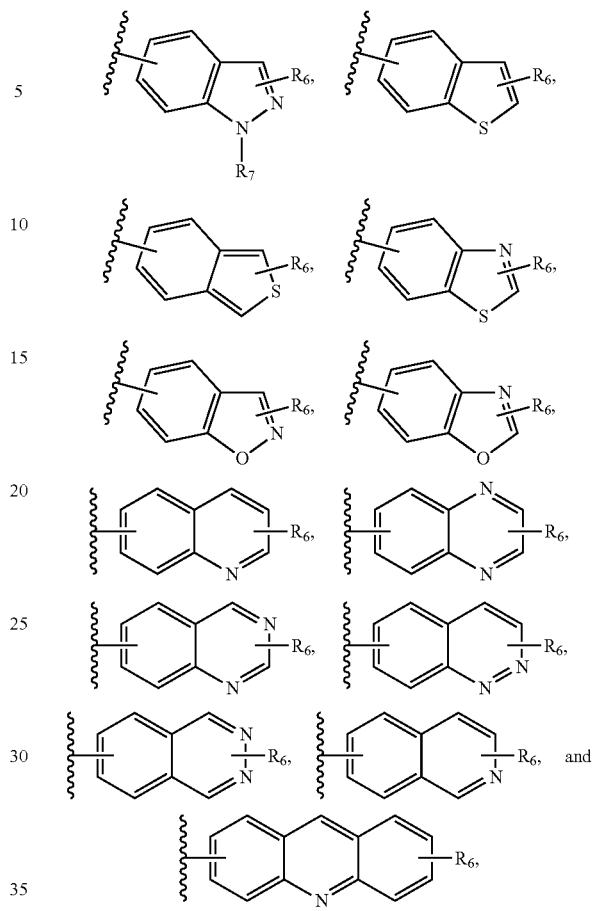

optionally substituted with one or more substituents selected from the group consisting of F, Cl, Br, $C_{1-4}$ alkyl, $CF_3$, $CHF_2$, $NO_2$, —$NR_7$—$(CH_2)_n$—$R_8$, —CO $NR_7$—$(CH_2)_n$—$R_8$, —CO—$(CH_2)_n$—$R_8$, —OCO—$(CH_2)_n$—$R_8$, and —O—$(CH_2)_n$—$R_8$. The number of the optional substituents can be an integer selected from 0 to 4.

In some embodiments, n can be an integer selected from 0 to 5. In some embodiments, $R_7$ can be selected from the group consisting of H, $C_{1-4}$ alkyl, and $COC_{1-4}$alkyl.

In some embodiments, $R_8$ can be selected from the group consisting of $C_{1-20}$alkyl, $COC_{1-20}$alkyl, $CO_2C_{1-20}$alkyl,

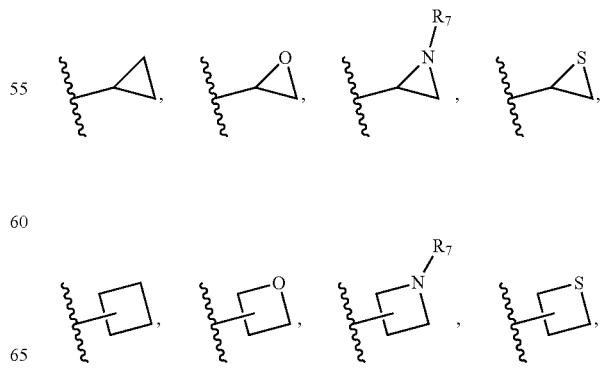

-continued

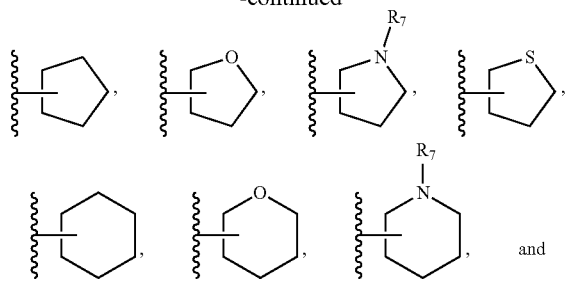

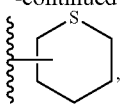

optionally substituted with one or more substituents selected from the group consisting of F, Cl, Br, $C_{1-4}$ alkyl, $CF_3$, $CHF_2$, and $NO_2$.

In some embodiments, the compound of the present disclosure is selected from the group consisting of compound 1-4 and 6-16 as shown in Table 1.

TABLE 1

The FGFR inhibitor compounds in the present disclosure.

| Compound Number | Chemical Structure |
|---|---|
| compound 1 | 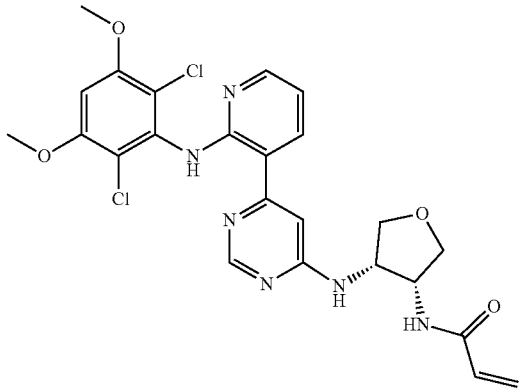 [SMILES: C=CC(=O)N[C@H]1COC[C@H]1Nc1cc(-c2cccnc2Nc2c(Cl)c(OC)cc(OC)c2Cl)ncn1] |
| compound 2 | 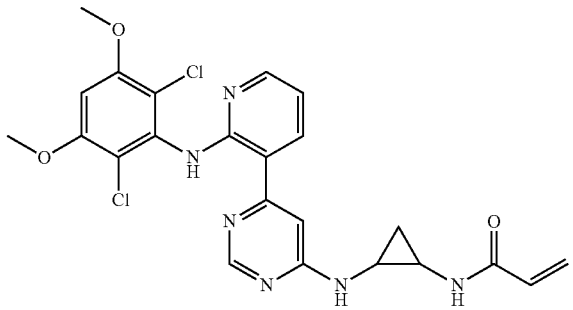 [SMILES: C=CC(=O)NC1CC1Nc1cc(-c2cccnc2Nc2c(Cl)c(OC)cc(OC)c2Cl)ncn1] |
| compound 3 | 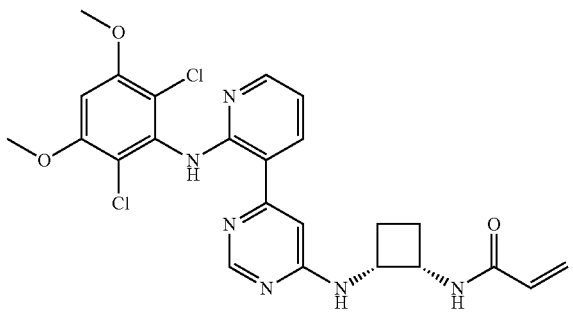 [SMILES: C=CC(=O)N[C@H]1CC[C@H]1Nc1cc(-c2cccnc2Nc2c(Cl)c(OC)cc(OC)c2Cl)ncn1] |

TABLE 1-continued
The FGFR inhibitor compounds in the present disclosure.
Compound Number   Chemical Structure
compound 4
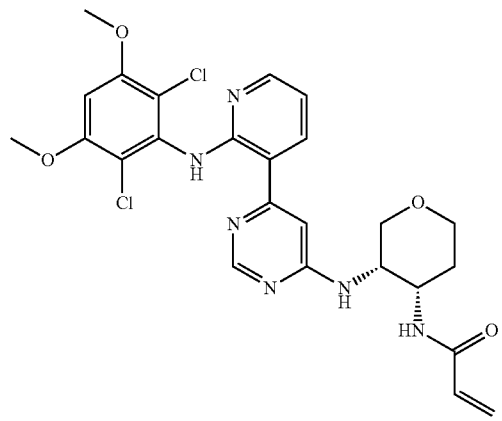 [SMILES: C=CC(=O)N[C@H]1CCOC[C@H]1Nc1cc(-c2cccnc2Nc2c(Cl)c(OC)cc(OC)c2Cl)ncn1]
compound 5
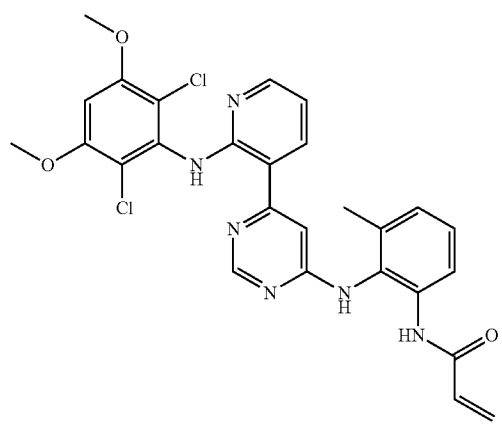 [SMILES: C=CC(=O)Nc1cccc(C)c1Nc1cc(-c2cccnc2Nc2c(Cl)c(OC)cc(OC)c2Cl)ncn1]
compound 6
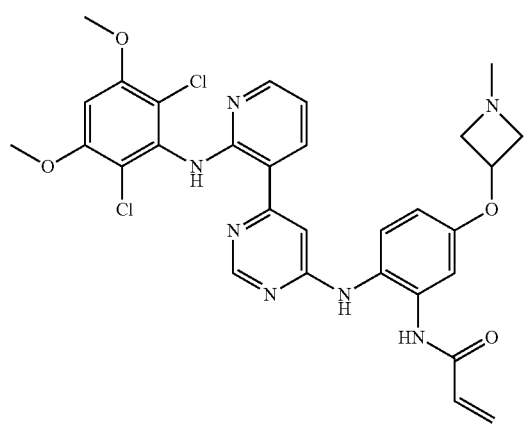 [SMILES: C=CC(=O)Nc1cc(OC2CN(C)C2)ccc1Nc1cc(-c2cccnc2Nc2c(Cl)c(OC)cc(OC)c2Cl)ncn1]

TABLE 1-continued
The FGFR inhibitor compounds in the present disclosure.
Compound Number   Chemical Structure
compound 7
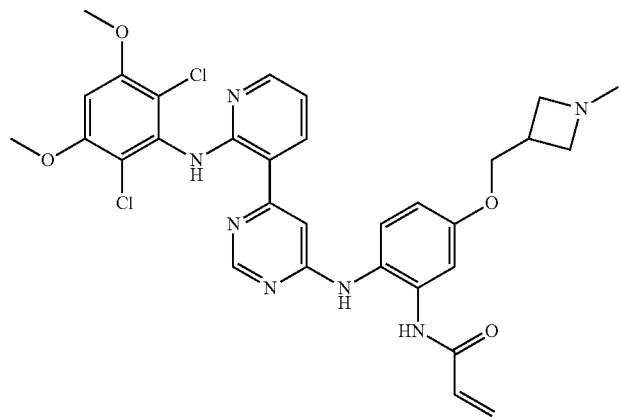
compound 8
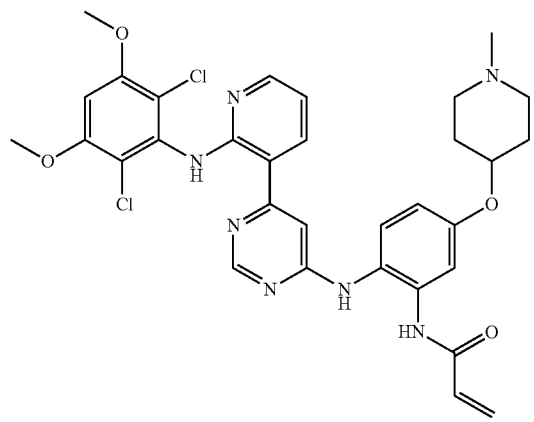 [SMILES: C=CC(=O)Nc1cc(OC2CCN(C)CC2)ccc1Nc1cc(-c2cccnc2Nc2c(Cl)c(OC)cc(OC)c2Cl)ncn1]
compound 9
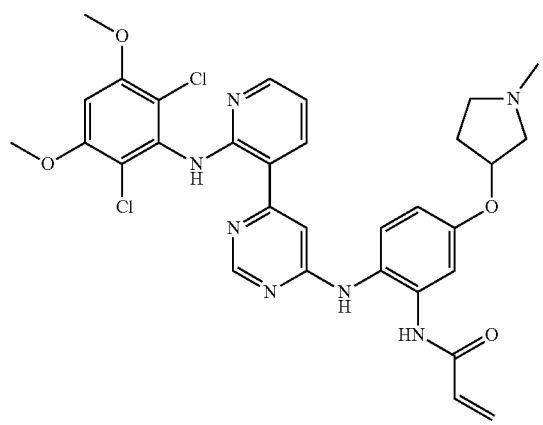

TABLE 1-continued
The FGFR inhibitor compounds in the present disclosure.
Compound Number   Chemical Structure
compound 10 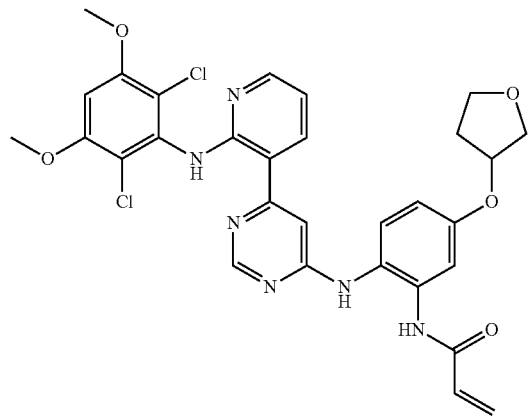 [SMILES: C=CC(=O)Nc1cc(OC2CCOC2)ccc1Nc1cc(-c2cccnc2Nc2c(Cl)c(OC)cc(OC)c2Cl)ncn1]
compound 11 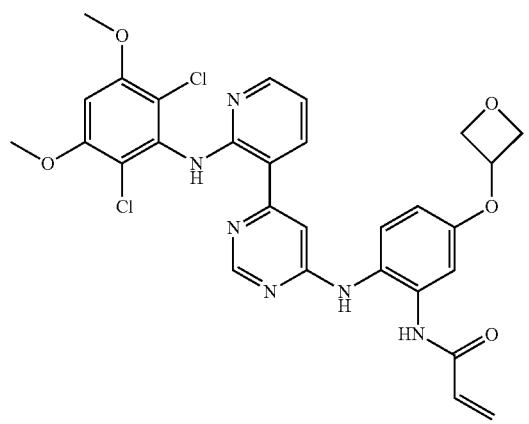 [SMILES: C=CC(=O)Nc1cc(OC2COC2)ccc1Nc1cc(-c2cccnc2Nc2c(Cl)c(OC)cc(OC)c2Cl)ncn1]
compound 12 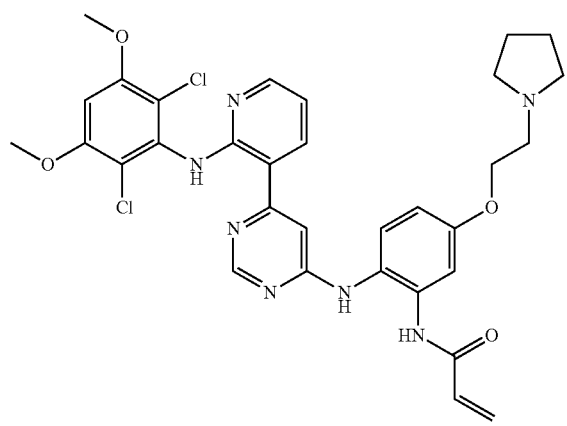 [SMILES: C=CC(=O)Nc1cc(OCCN2CCCC2)ccc1Nc1cc(-c2cccnc2Nc2c(Cl)c(OC)cc(OC)c2Cl)ncn1]

TABLE 1-continued

The FGFR inhibitor compounds in the present disclosure.

| Compound Number | Chemical Structure |
| --- | --- |
| compound 13 | 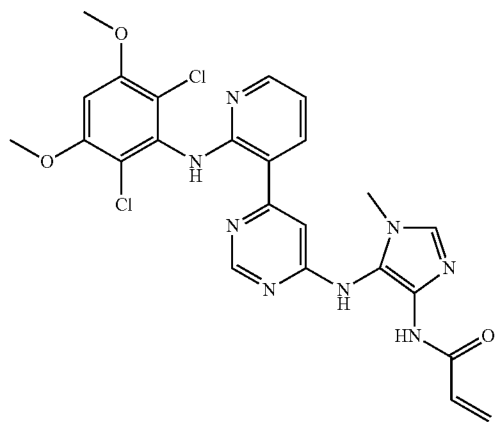 [SMILES: C=CC(=O)Nc1ncn(C)c1Nc1cc(-c2cccnc2Nc2c(Cl)c(OC)cc(OC)c2Cl)ncn1] |
| compound 14 | 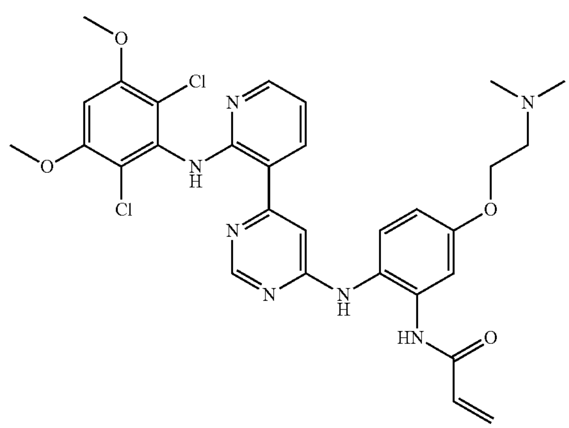 |
| compound 15 | 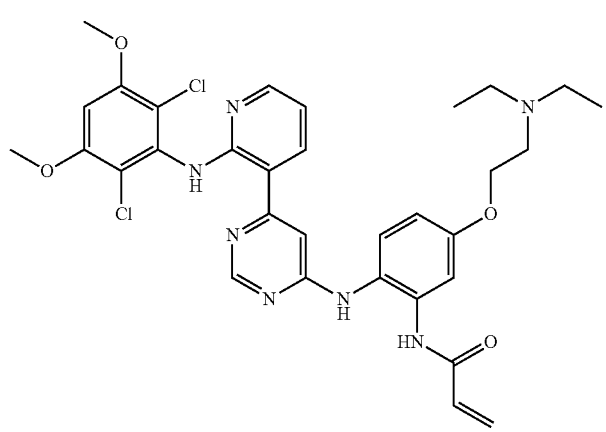 [SMILES: C=CC(=O)Nc1cc(OCCN(CC)CC)ccc1Nc1cc(-c2cccnc2Nc2c(Cl)c(OC)cc(OC)c2Cl)ncn1] |

TABLE 1-continued

The FGFR inhibitor compounds in the present disclosure.

| Compound Number | Chemical Structure |
|---|---|
| compound 16 | 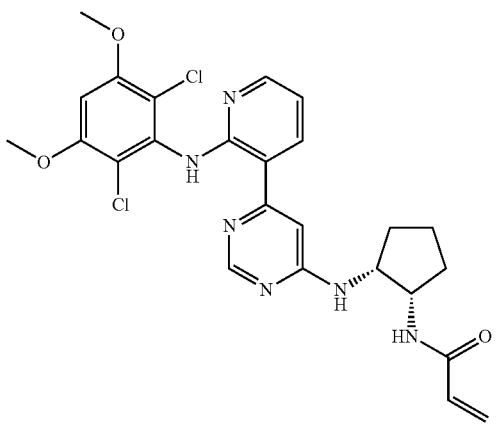 [SMILES: C=CC(=O)N[C@H]1CCC[C@H]1Nc1cc(-c2cccnc2Nc2c(Cl)c(OC)cc(OC)c2Cl)ncn1] |

The present disclosure also provides a pharmaceutical formulation including the compound according to Formula (I), Formula (II), Formula (III), or an optically pure stereoisomer or pharmaceutically acceptable salt thereof. The present disclosure further provides a method for treating cancer in a subject including administering a compound with the structure of Formula (I), Formula (II), Formula (III), or an optically pure stereoisomer or pharmaceutically acceptable salt thereof to the subject. The present disclosure also provides a method of inhibiting a kinase activity including contacting a cell with a compound with the structure of Formula (I), Formula (II), Formula (III), or an optically pure stereoisomer or pharmaceutically acceptable salt thereof. In some embodiments, the kinase can be Anaplastic lymphoma kinase (ALK), Epidermal growth factor receptor (EGFR), Ephrin type-3 receptor 3 (EPH-B3), Focal adhesion kinase (FAK), Fibroblast growth factor receptor 1 (FGFR1), Fibroblast growth factor receptor 2 (FGFR2), Fibroblast growth factor receptor 3 (FGFR3), Fibroblast growth factor receptor 4 (FGFR4), Mast/stem cell growth factor receptor (SCFR or KIT), Mitogen-activated protein kinase kinase 1 (MAP2K1 or MEK1), Hepatocyte growth factor receptor (HGFR or MET), Platelet-derived growth factor receptor alpha (PDG-FRA), Platelet-derived growth factor receptor beta (PDG-FRB), Proto-oncogene tyrosine kinase receptor (RET), Proto-oncogene tyrosine-protein kinase (ROS) or Tyrosine-protein kinase receptor (TYRO 3). The cell can be a cancer cell. The cancer cell can be a breast, lung, bladder, prostate, ovarian, endometrial, rhabdomyosarcoma, liver or gastric cancer cell.

The present disclosure specifically provides compounds with non-obvious property improvement compared to control structures such as compound 5 with the structure of

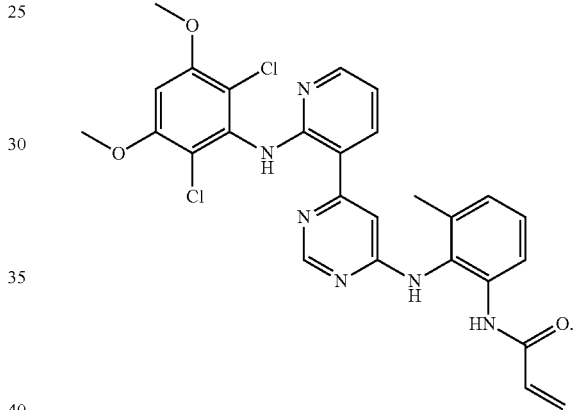

The IUPAC name of the compound is N-(2-((6-(2-((2,6-dichloro-3,5-dimethoxyphenyl)amino)pyridin-3-yl)pyrimidin-4-yl)amino)-3-methylphenyl)acrylamide.

The term "about" will be understood by persons of ordinary skill in the art. Whether the term "about" is used explicitly or not, every quantity given herein refers to the actual given value, and it is also meant to refer to the approximation to such given value that would be reasonably inferred based on the ordinary skill in the art.

Alkyl groups refer to univalent groups derived from alkanes by removal of a hydrogen atom from any carbon atom, which include straight chain and branched chain with from 1 to 12 carbon atoms, and typically from 1 to about 10 carbons or in some embodiments, from 1 to about 6 carbon atoms, or in other embodiments having 1, 2, 3 or 4 carbon atoms. Examples of straight chain alkyl groups include, but are not limited to, methyl, ethyl, n-propyl, n-butyl, n-pentyl, and n-hexyl groups. Examples of branched chain alkyl groups include, but are not limited to isopropyl, isobutyl, sec-butyl and tert-butyl groups. Alkyl groups may be substituted or unsubstituted. Representative substituted alkyl groups may be mono-substituted or substituted more than once, such as, but not limited to, mono-, di-, or tri-substituted. As used herein, the term alkyl, unless otherwise stated, refers to both cyclic and noncyclic groups.

The terms "cyclic alkyl" or "cycloalkyl" refer to univalent groups derived from cycloalkanes by removal of a hydrogen atom from a ring carbon atom. Cycloalkyl groups are saturated or partially saturated non-aromatic structures with a single ring or multiple rings including isolated, fused, bridged, and spiro ring systems, having 3 to 14 carbon atoms, or in some embodiments, from 3 to 12, or 3 to 10, or 3 to 8, or 3, 4, 5, 6 or 7 carbon atoms. Cycloalkyl groups may be substituted or unsubstituted. Representative substituted cycloalkyl groups may be mono-substituted or substituted more than once, such as, but not limited to, mono-, di-, or tri-substituted. Examples of monocyclic cycloalkyl groups include, but are not limited to cyclopropyl, cyclobutyl, cyclopentyl, and cyclohexyl groups. Examples of multicyclic ring systems include, but are not limited to, bicycle [4.4.0]decane, bicycle[2.2.1]heptane, spiro[2.2]pentane, and the like.

Alkenyl groups refer to straight and branched chain and cycloalkyl groups as defined above, with one or more double bonds between two carbon atoms. Alkenyl groups may have 2 to about 12 carbon atoms, or in some embodiment from 1 to about 10 carbons or in other embodiments, from 1 to about 6 carbon atoms, or 1, 2, 3 or 4 carbon atoms in other embodiments. Alkenyl groups may be substituted or unsubstituted. Representative substituted alkenyl groups may be mono-substituted or substituted more than once, such as, but not limited to, mono-, di-, or tri-substituted. Examples of alkenyl groups include, but are not limited to, vinyl, allyl, —CH═CH($CH_3$), —CH═C($CH_3$)$_2$, —C($CH_3$)═$CH_2$, cyclopentenyl, cyclohexenyl, butadienyl, pentadienyl, and hexadienyl, among others.

Alkynyl groups refer to straight and branched chain and cycloalkyl groups as defined above, with one or more triple bonds between two carbon atoms. Alkynyl groups may have 2 to about 12 carbon atoms, or in some embodiment from 1 to about 10 carbons or in other embodiments, from 1 to about 6 carbon atoms, or 1, 2, 3 or 4 carbon atoms in other embodiments. Alkynyl groups may be substituted or unsubstituted. Representative substituted alkynyl groups may be mono-substituted or substituted more than once, such as, but not limited to, mono-, di-, or tri-substituted. Exemplary alkynyl groups include, but are not limited to, ethynyl, propargyl, and —C≡C($CH_3$), among others.

Aryl groups are cyclic aromatic hydrocarbons that include single and multiple ring compounds, including multiple ring compounds that contain separate and/or fused aryl groups. Aryl groups may contain from 6 to about 18 ring carbons, or in some embodiments from 6 to 14 ring carbons or even 6 to 10 ring carbons in other embodiments. Aryl group also includes heteroaryl groups, which are aromatic ring compounds containing 5 or more ring members, one or more ring carbon atoms of which are replaced with heteroatom such as, but not limited to, N, O, and S. Aryl groups may be substituted or unsubstituted. Representative substituted aryl groups may be mono-substituted or substituted more than once, such as, but not limited to, mono-, di-, or tri-substituted. Aryl groups include, but are not limited to, phenyl, biphenylenyl, triphenylenyl, naphthyl, anthryl, and pyrenyl groups.

Suitable heterocyclyl groups include cyclic groups with atoms of at least two different elements as members of its rings, of which one or more is a heteroatom such as, but not limited to, N, O, or S. Heterocyclyl groups may include 3 to about 20 ring members, or 3 to 18 in some embodiments, or about 3 to 15, 3 to 12, 3 to 10, or 3 to 6 ring members. The ring systems in heterocyclyl groups may be unsaturated, partially saturated, and/or saturated. Heterocyclyl groups may be substituted or unsubstituted. Representative substituted heterocyclyl groups may be mono-substituted or substituted more than once, such as, but not limited to, mono-, di-, or tri-substituted. Exemplary heterocyclyl groups include, but are not limited to, pyrrolidinyl, tetrahydrofuryl, dihydrofuryl, tetrahydrothienyl, tetrahydrothiopyranyl, piperidyl, morpholinyl, thiomorpholinyl, thioxanyl, piperazinyl, azetidinyl, aziridinyl, imidazolidinyl, pyrazolidinyl, thiazolidinyl, tetrahydrothiophenyl, tetrahydrofuranyl, dioxolyl, furanyl, thiophenyl, pyrrolyl, imidazolyl, pyrazolyl, pyrazolinyl, triazolyl, tetrazolyl, oxazolyl, isoxazolyl, thiazolyl, thiazolinyl, oxetanyl, thietanyl, homopiperidyl, oxepanyl, thiepanyl, oxazepinyl, diazepinyl, thiazepinyl, 1,2,3,6-tetrahydropyridyl, indolinyl, 2H-pyranyl, 4H-pyranyl, dioxolanyl, dioxanyl, purinyl, quinolizinyl, cinnolinyl, phthalazinyl, pteridinyl, and benzothiazolyl groups.

Polycyclic or polycyclyl groups refer to two or more rings in which two or more carbons are common to the two adjoining rings, wherein the rings are "fused rings"; if the rings are joined by one common carbon atom, these are "spiro" ring systems. Rings that are joined through non-adjacent atoms are "bridged" rings. Polycyclic groups may be substituted or unsubstituted. Representative polycyclic groups may be substituted one or more times.

Halogen groups include F, Cl, Br, and I; nitro group refers to —$NO_2$; cyano group refers to —CN; isocyano group refers to —N≡C; epoxy groups encompass structures in which an oxygen atom is directly attached to two adjacent or non-adjacent carbon atoms of a carbon chain or ring system, which is essentially a cyclic ether structure. An epoxide is a cyclic ether with a three-atom ring.

An alkoxy group is a substituted or unsubstituted alkyl group, as defined above, singular bonded to oxygen. Alkoxy groups may be substituted or unsubstituted. Representative substituted alkoxy groups may be substituted one or more times. Exemplary alkoxy groups include, but are not limited to, methoxy, ethoxy, propoxy, butoxy, pentoxy, hexoxy, isopropoxy, sec-butoxy, tert-butoxy, cyclopropyloxy, cyclobutyloxy, cyclopentyloxy, and cyclohexyloxy groups.

The terms "amine" and "amino" refer to derivatives of ammonia, wherein one of more hydrogen atoms have been replaced by a substituent which include, but are not limited to alkyl, alkenyl, aryl, and heterocyclyl groups. Carbamate groups refers to —O(C═O)$NR_1R_2$, where $R_1$ and $R_2$ are independently hydrogen, aliphatic groups, aryl groups, or heterocyclyl groups.

The term "optionally substituted" means the anteceding group may be substituted or unsubstituted. When substituted, the substituents of an "optionally substituted" group may include, without limitation, one or more substituents independently selected from the following groups or a particular designated set of groups, alone or in combination: lower alkyl, lower alkenyl, lower alkynyl, lower alkanoyl, lower heteroalkyl, lower heterocycloalkyl, lower haloalkyl, lower haloalkenyl, lower haloalkynyl, lower perhaloalkyl, lower perhaloalkoxy, lower cycloalkyl, phenyl, aryl, aryloxy, lower alkoxy, lower haloalkoxy, oxo, lower acyloxy, carbonyl, carboxyl, lower alkylcarbonyl, lower carboxyester, lower carboxamido, cyano, hydrogen, halogen, hydroxy, amino, lower alkylamino, arylamino, amido, nitro, thiol, lower alkylthio, lower haloalkylthio, lower perhaloalkylthio, arylthio, sulfonate, sulfonic acid, trisubstituted silyl, $N_3$, SH, $SCH_3$, C(O)$CH_3$, $CO_2CH_3$, $CO_2H$, pyridinyl, thiophene, furanyl, lower carbamate, and lower urea. Two substituents may be joined together to form a fused five-, six-, or seven-membered carbocyclic or heterocyclic ring consisting of zero to three heteroatoms, for example forming methylenedioxy or ethylenedioxy. An optionally substituted group may be unsubstituted (e.g., —CH₂CH₃), fully substituted (e.g., —CF₂CF₃), monosubstituted (e.g., —CH₂CH₂F) or substituted at a level anywhere in-between fully substituted and monosubstituted (e.g., —CH₂CF₃). Where substituents are recited without qualification as to substitution, both substituted and unsubstituted forms are encompassed. Where a substituent is qualified as "substituted," the substituted form is specifically intended. Additionally, different sets of optional substituents to a particular moiety may be defined as needed; in these cases, the optional substitution will be as defined, often immediately following the phrase, "optionally substituted with."

Pharmaceutically acceptable salts of compounds described herein include conventional nontoxic salts or quaternary ammonium salts of a compound, e.g., from non-toxic organic or inorganic acids. For example, such conventional nontoxic salts include those derived from inorganic acids such as hydrochloride, hydrobromic, sulfuric, sulfamic, phosphoric, nitric, and the like; and the salts prepared from organic acids such as acetic, propionic, succinic, glycolic, stearic, lactic, malic, tartaric, citric, ascorbic, palmitic, maleic, hydroxymaleic, phenylacetic, glutamic, benzoic, salicyclic, sulfanilic, 2-acetoxybenzoic, fumaric, toluenesulfonic, methanesulfonic, ethane disulfonic, oxalic, isothionic, and the like. In other cases, described compounds may contain one or more acidic functional groups and, thus, are capable of forming pharmaceutically acceptable salts with pharmaceutically acceptable bases. These salts can likewise be prepared in situ in the administration vehicle or the dosage form manufacturing process, or by separately reacting the purified compound in its free acid form with a suitable base, such as the hydroxide, carbonate or bicarbonate of a pharmaceutically acceptable metal cation, with ammonia, or with a pharmaceutically acceptable organic primary, secondary or tertiary amine. Representative alkali or alkaline earth salts include the lithium, sodium, potassium, calcium, magnesium, and aluminum salts and the like. Representative organic amines useful for the formation of base addition salts include ethylamine, diethylamine, ethylenediamine, ethanolamine, diethanolamine, piperazine and the like.

The term "treatment" is used interchangeably herein with the term "therapeutic method" and refers to both 1) therapeutic treatments or measures that cure, slow down, lessen symptoms of, and/or halt progression of a diagnosed pathologic conditions, disease or disorder, and 2) and prophylactic/preventative measures. Those in need of treatment may include individuals already having a particular medical disease or disorder as well as those who may ultimately acquire the disorder (i.e., those needing preventive measures).

The term "subject" as used herein refers to any individual or patient to which the subject methods are performed. Generally, the subject is human, although as will be appreciated by those in the art, the subject may be an animal.

The terms "therapeutically effective amount", "effective dose", "therapeutically effective dose", "effective amount," or the like refer to the amount of a subject compound that will elicit the biological or medical response in a tissue, system, animal or human that is being sought by administering said compound. Generally, the response is either amelioration of symptoms in a patient or a desired biological outcome. Such amount should be sufficient to inhibit FGFR enzymatic activity.

Also disclosed herein are pharmaceutical compositions including compounds with the structures of Formula (I), Formula (II), or Formula (III). The term "pharmaceutically acceptable carrier" refers to a non-toxic carrier that may be administered to a patient, together with a compound of this disclosure, and which does not destroy the pharmacological activity thereof. Pharmaceutically acceptable carriers that may be used in these compositions include, but are not limited to, ion exchangers, alumina, aluminum stearate, lecithin, serum proteins such as human serum albumin, buffer substances such as phosphates, glycine, sorbic acid, potassium sorbate, partial glyceride mixtures of saturated vegetable fatty acids, water, salts or electrolytes such as protamine sulfate, disodium hydrogen phosphate, potassium hydrogen phosphate, sodium chloride, zinc salts, colloidal silica, magnesium trisilicate, polyvinyl pyrrolidone, cellulose-based substances, polyethylene glycol, sodium carboxymethylcellulose, polyacrylates, waxes, polyethylene-polyoxypropylene-block polymers, polyethylene glycol and wool fat.

Pharmaceutically acceptable carriers that may be used in the pharmaceutical compositions of this disclosure include, but are not limited to, ion exchangers, alumina, aluminum stearate, lecithin, serum proteins, such as human serum albumin, buffer substances such as phosphates, glycine, sorbic acid, potassium sorbate, partial glyceride mixtures of saturated vegetable fatty acids, water, salts or electrolytes, such as protamine sulfate, disodium hydrogen phosphate, potassium hydrogen phosphate, sodium chloride, zinc salts, colloidal silica, magnesium trisilicate, polyvinyl pyrrolidone, cellulose-based substances, polyethylene glycol, sodium carboxymethylcellulose, polyacrylates, waxes, polyethylene-polyoxypropylene-block polymers, wool fat and self-emulsifying drug delivery systems (SEDDS) such as α-tocopherol, polyethyleneglycol 1000 succinate, or other similar polymeric delivery matrices.

In pharmaceutical composition comprising only the compounds described herein as the active component, methods for administering these compositions may additionally comprise the step of administering to the subject an additional agent or therapy. Such therapies include, but are not limited to, an anemia therapy, a diabetes therapy, a hypertension therapy, a cholesterol therapy, neuropharmacologic drugs, drugs modulating cardiovascular function, drugs modulating inflammation, immune function, production of blood cells; hormones and antagonists, drugs affecting gastrointestinal function, chemotherapeutics of microbial diseases, and/or chemotherapeutics of neoplastic disease. Other pharmacological therapies can include any other drug or biologic found in any drug class. For example, other drug classes can comprise allergy/cold/ENT therapies, analgesics, anesthetics, anti-inflammatories, antimicrobials, antivirals, asthma/pulmonary therapies, cardiovascular therapies, dermatology therapies, endocrine/metabolic therapies, gastrointestinal therapies, cancer therapies, immunology therapies, neurologic therapies, ophthalmic therapies, psychiatric therapies or rheumatologic therapies. Other examples of agents or therapies that can be administered with the compounds described herein include a matrix metalloprotease inhibitor, a lipoxygenase inhibitor, a cytokine antagonist, an immunosuppressant, a cytokine, a growth factor, an immunomodulator, a prostaglandin or an anti-vascular hyperproliferation compound.

The term "therapeutically effective amount" as used herein refers to the amount of active compound or pharmaceutical agent that elicits the biological or medicinal response in a tissue, system, animal, individual or human that is being sought by a researcher, veterinarian, medical doctor or other clinician, which includes one or more of the following: (1) Preventing the disease; for example, preventing a disease, condition or disorder in an individual that may be predisposed to the disease, condition or disorder but does not yet experience or display the pathology or symptomatology of the disease, (2) Inhibiting the disease; for example, inhibiting a disease, condition or disorder in an individual that is experiencing or displaying the pathology or symptomatology of the disease, condition or disorder (i.e., arresting further development of the pathology and/or symptomatology), and (3) Ameliorating the disease; for example, ameliorating a disease, condition or disorder in an individual that is experiencing or displaying the pathology or symptomatology of the disease, condition or disorder (i.e., reversing the pathology and/or symptomatology).

The compounds of this disclosure may be employed in a conventional manner for controlling the disease described herein, including, but not limited to, cancer. Such methods of treatment, their dosage levels and requirements may be selected by those of ordinary skill in the art from available methods and techniques. For example, the compounds of this disclosure may be combined with a pharmaceutically acceptable adjuvant for administration to a patient suffering from cancer in a pharmaceutically acceptable manner and in an amount effective to treat cancer.

Alternatively, the compounds of this disclosure may be used in compositions and methods for treating or protecting individuals against the diseases described herein, including but not limited to a cancer, over extended periods of time. The compounds may be employed in such compositions either alone or together with other compounds of this disclosure in a manner consistent with the conventional utilization of such compounds in pharmaceutical compositions. For example, a compound of this disclosure may be combined with pharmaceutically acceptable adjuvants conventionally employed in vaccines and administered in prophylactically effective amounts to protect individuals over an extended period of time against the diseases described herein, including, but not limited to, cancer.

As used herein, the terms "combination," "combined," and related terms refer to the simultaneous or sequential administration of therapeutic agents in accordance with this disclosure. For example, a described compound may be administered with another therapeutic agent simultaneously or sequentially in separate unit dosage forms or together in a single unit dosage form. Accordingly, the present disclosure provides a single unit dosage form comprising a described compound, an additional therapeutic agent, and a pharmaceutically acceptable carrier, adjuvant, or vehicle. Two or more agents are typically considered to be administered "in combination" when a patient or individual is simultaneously exposed to both agents. In many embodiments, two or more agents are considered to be administered "in combination" when a patient or individual simultaneously shows therapeutically relevant levels of the agents in a particular target tissue or sample (e.g., in brain, in serum, etc.).

When the compounds of this disclosure are administered in combination therapies with other agents, they may be administered sequentially or concurrently to the patient. Alternatively, pharmaceutical or prophylactic compositions according to this disclosure comprise a combination of ivermectin, or any other compound described herein, and another therapeutic or prophylactic agent. Additional therapeutic agents that are normally administered to treat a particular disease or condition may be referred to as "agents appropriate for the disease, or condition, being treated."

The compounds utilized in the compositions and methods of this disclosure may also be modified by appending appropriate functionalities to enhance selective biological properties. Such modifications are known in the art and include those, which increase biological penetration into a given biological system (e.g., blood, lymphatic system, or central nervous system), increase oral availability, increase solubility to allow administration by injection, alter metabolism and/or alter rate of excretion.

According to a preferred embodiment, the compositions of this disclosure are formulated for pharmaceutical administration to a subject or patient, e.g., a mammal, preferably a human being. Such pharmaceutical compositions are used to ameliorate, treat or prevent any of the diseases described herein including but not limited to cancer in a subject.

Agents of the disclosure are often administered as pharmaceutical compositions comprising an active therapeutic agent, i.e., and a variety of other pharmaceutically acceptable components. See Remington's Pharmaceutical Science (15th ed., Mack Publishing Company, Easton, Pa., 1980). The preferred form depends on the intended mode of administration and therapeutic application. The compositions can also include, depending on the formulation desired, pharmaceutically acceptable, non-toxic carriers or diluents, which are defined as vehicles commonly used to formulate pharmaceutical compositions for animal or human administration. The diluent is selected so as not to affect the biological activity of the combination. Examples of such diluents are distilled water, physiological phosphate-buffered saline, Ringer's solutions, dextrose solution, and Hank's solution. In addition, the pharmaceutical composition or formulation may also include other carriers, adjuvants, or nontoxic, nontherapeutic, nonimmunogenic stabilizers and the like.

In some embodiments, the present disclosure provides pharmaceutically acceptable compositions comprising a therapeutically effective amount of one or more of a described compound, formulated together with one or more pharmaceutically acceptable carriers (additives) and/or diluents for use in treating the diseases described herein, including, but not limited to cancer. While it is possible for a described compound to be administered alone, it is preferable to administer a described compound as a pharmaceutical formulation (composition) as described herein. Described compounds may be formulated for administration in any convenient way for use in human or veterinary medicine, by analogy with other pharmaceuticals.

As described in detail, pharmaceutical compositions of the present disclosure may be specially formulated for administration in solid or liquid form, including those adapted for the following: oral administration, for example, drenches (aqueous or non-aqueous solutions or suspensions), tablets, e.g., those targeted for buccal, sublingual, and systemic absorption, boluses, powders, granules, pastes for application to the tongue; parenteral administration, for example, by subcutaneous, intramuscular, intravenous or epidural injection as, for example, a sterile solution or suspension, or sustained-release formulation; topical application, for example, as a cream, ointment, or a controlled-release patch or spray applied to the skin, lungs, or oral cavity; intravaginally or intrarectally, for example, as a pessary, cream or foam; sublingually; ocularly; transdermally; or nasally, pulmonary and to other mucosal surfaces.

Wetting agents, emulsifiers and lubricants, such as sodium lauryl sulfate and magnesium stearate, as well as coloring agents, release agents, coating agents, sweetening, flavoring and perfuming agents, preservatives and antioxidants can also be present in the compositions.

Examples of pharmaceutically acceptable antioxidants include: water soluble antioxidants, such as ascorbic acid, cysteine hydrochloride, sodium bisulfate, sodium metabisulfite, sodium sulfite and the like; oil-soluble antioxidants, such as ascorbyl palmitate, butylated hydroxyanisole (BHA), butylated hydroxytoluene (BHT), lecithin, propyl gallate, alpha-tocopherol, and the like; and metal chelating agents, such as citric acid, ethylenediamine tetraacetic acid (EDTA), sorbitol, tartaric acid, phosphoric acid, and the like.

Formulations for use in accordance with the present disclosure include those suitable for oral, nasal, topical (including buccal and sublingual), rectal, vaginal and/or parenteral administration. The formulations may conveniently be presented in unit dosage form and may be prepared by any methods well known in the art of pharmacy. The amount of active ingredient, which can be combined with a carrier material, to produce a single dosage form will vary depending upon the host being treated, and the particular mode of administration. The amount of active ingredient that can be combined with a carrier material to produce a single dosage form will generally be that amount of the compound, which produces a therapeutic effect. Generally, this amount will range from about 1% to about 99% of active ingredient. In some embodiments, this amount will range from about 5% to about 70%, from about 10% to about 50%, or from about 20% to about 40%.

In certain embodiments, a formulation as described herein comprises an excipient selected from the group consisting of cyclodextrins, liposomes, micelle forming agents, e.g., bile acids, and polymeric carriers, e.g., polyesters and polyanhydrides; and a compound of the present disclosure. In certain embodiments, an aforementioned formulation renders orally bioavailable a described compound of the present disclosure.

Methods of preparing formulations or compositions comprising described compounds include a step of bringing into association a compound of the present disclosure with the carrier and, optionally, one or more accessory ingredients. In general, formulations may be prepared by uniformly and intimately bringing into association a compound of the present disclosure with liquid carriers, or finely divided solid carriers, or both, and then, if necessary, shaping the product.

The pharmaceutical compositions may be in the form of a sterile injectable preparation, for example, as a sterile injectable aqueous or oleaginous suspension. This suspension may be formulated according to techniques known in the art using suitable dispersing or wetting agents (such as, for example, Tween 80) and suspending agents. The sterile injectable preparation may also be a sterile injectable solution or suspension in a non-toxic parenterally acceptable diluent or solvent, for example, as a solution in 1,3-butanediol. Among the acceptable vehicles and solvents that may be employed are mannitol, water, Ringer's solution and isotonic sodium chloride solution. In addition, sterile, fixed oils are conventionally employed as a solvent or suspending medium. For this purpose, any bland fixed oil may be employed including synthetic mono- or diglycerides. Fatty acids, such as oleic acid and its glyceride derivatives are useful in the preparation of injectables, as are natural pharmaceutically acceptable oils, such as olive oil or castor oil, especially in their polyoxyethylated versions. These oil solutions or suspensions may also contain a long-chain alcohol diluent or dispersant, such as those described in Pharmacopeia Helvetica, or a similar alcohol. Other commonly used surfactants, such as Tweens, Spans and other emulsifying agents or bioavailability enhancers which are commonly used in the manufacture of pharmaceutically acceptable solid, liquid, or other dosage forms may also be used for the purposes of formulation.

In some cases, in order to prolong the effect of a drug, it may be desirable to slow the absorption of the drug from subcutaneous or intramuscular injection. This may be accomplished by the use of a liquid suspension of crystalline or amorphous material having poor water solubility. The rate of absorption of the drug then depends upon its rate of dissolution, which in turn, may depend upon crystal size and crystalline form. Alternatively, delayed absorption of a parenterally administered drug form is accomplished by dissolving or suspending the drug in an oil vehicle.

Injectable depot forms are made by forming microencapsule matrices of the described compounds in biodegradable polymers such as polylactide-polyglycolide. Depending on the ratio of drug to polymer, and the nature of the particular polymer employed, the rate of drug release can be controlled. Examples of other biodegradable polymers include poly(orthoesters) and poly(anhydrides). Depot injectable formulations are also prepared by entrapping the drug in liposomes or microemulsions, which are compatible with body tissue.

The pharmaceutical compositions of this disclosure may be orally administered in any orally acceptable dosage form including, but not limited to, capsules, tablets, and aqueous suspensions and solutions. In the case of tablets for oral use, carriers, which are commonly used include lactose and corn starch. Lubricating agents, such as magnesium stearate, are also typically added. For oral administration in a capsule form, useful diluents include lactose and dried cornstarch. When aqueous suspensions and solutions and propylene glycol are administered orally, the active ingredient is combined with emulsifying and suspending agents. If desired, certain sweetening and/or flavoring and/or coloring agents may be added.

Formulations described herein suitable for oral administration may be in the form of capsules, cachets, pills, tablets, lozenges (using a flavored basis, usually sucrose and acacia or tragacanth), powders, granules, or as a solution or a suspension in an aqueous or non-aqueous liquid, or as an oil-in-water or water-in-oil liquid emulsion, or as an elixir or syrup, or as pastilles (using an inert base, such as gelatin and glycerin, or sucrose and acacia) and/or as mouth washes and the like, each containing a predetermined amount of a compound of the present disclosure as an active ingredient. Compounds described herein may also be administered as a bolus, electuary or paste.

In solid dosage forms for oral administration (capsules, tablets, pills, dragees, powders, granules and the like), an active ingredient is mixed with one or more pharmaceutically-acceptable carriers, such as sodium citrate or dicalcium phosphate, and/or any of the following: fillers or extenders, such as starches, lactose, sucrose, glucose, mannitol, and/or silicic acid; binders, such as, for example, carboxymethylcellulose, alginates, gelatin, polyvinyl pyrrolidone, sucrose and/or acacia; humectants, such as glycerol; disintegrating agents, such as agar-agar, calcium carbonate, potato or tapioca starch, alginic acid, certain silicates, and sodium carbonate; solution retarding agents, such as paraffin; absorption accelerators, such as quaternary ammonium compounds; wetting agents, such as, for example, cetyl alcohol, glycerol monostearate, and non-ionic surfactants; absorbents, such as kaolin and bentonite clay; lubricants, such as talc, calcium stearate, magnesium stearate, solid polyethylene glycols, sodium lauryl sulfate, and mixtures thereof; and coloring agents. In the case of capsules, tablets and pills, the pharmaceutical compositions may also comprise buffering agents. Solid compositions of a similar type may also be employed as fillers in soft and hard-shelled gelatin capsules using such excipients as lactose or milk sugars, as well as high molecular weight polyethylene glycols and the like.

Tablets may be made by compression or molding, optionally with one or more accessory ingredients. Compressed tablets may be prepared using binder (for example, gelatin or hydroxypropylmethyl cellulose), lubricant, inert diluent, preservative, disintegrant (for example, sodium starch glycolate or cross-linked sodium carboxymethyl cellulose), surface-active or dispersing agent. Molded tablets may be made in a suitable machine in which a mixture of the powdered compound is moistened with an inert liquid diluent. If a solid carrier is used, the preparation can be in tablet form, placed in a hard gelatin capsule in powder or pellet form, or in the form of a troche or lozenge. The amount of solid carrier will vary, e.g., from about 25 to 800 mg, preferably about 25 mg to 400 mg. When a liquid carrier is used, the preparation can be, e.g., in the form of a syrup, emulsion, soft gelatin capsule, sterile injectable liquid such as an ampule or nonaqueous liquid suspension. Where the composition is in the form of a capsule, any routine encapsulation is suitable, for example, using the aforementioned carriers in a hard gelatin capsule shell.

Tablets and other solid dosage forms, such as dragees, capsules, pills and granules, may optionally be scored or prepared with coatings and shells, such as enteric coatings and other coatings well known in the pharmaceutical-formulating art. They may alternatively or additionally be formulated so as to provide slow or controlled release of the active ingredient therein using, for example, hydroxypropylmethyl cellulose in varying proportions to provide the desired release profile, other polymer matrices, liposomes and/or microspheres. They may be formulated for rapid release, e.g., freeze-dried. They may be sterilized by, for example, filtration through a bacteria-retaining filter, or by incorporating sterilizing agents in the form of sterile solid compositions that can be dissolved in sterile water, or some other sterile injectable medium immediately before use. These compositions may also optionally contain opacifying agents and may be of a composition that they release the active ingredient(s) only, or preferentially, in a certain portion of the gastrointestinal tract, optionally, in a delayed manner. Examples of embedding compositions that can be used include polymeric substances and waxes. The active ingredient can also be in micro-encapsulated form, if appropriate, with one or more of the above-described excipients.

Liquid dosage forms for oral administration of compounds of the disclosure include pharmaceutically acceptable emulsions, microemulsions, solutions, suspensions, syrups and elixirs. In addition to the active ingredient, the liquid dosage forms may contain inert diluents commonly used in the art, such as, for example, water or other solvents, solubilizing agents and emulsifiers, such as ethyl alcohol, isopropyl alcohol, ethyl carbonate, ethyl acetate, benzyl alcohol, benzyl benzoate, propylene glycol, 1,3-butylene glycol, oils (in particular, cottonseed, groundnut, corn, germ, olive, castor and sesame oils), glycerol, tetrahydrofuryl alcohol, polyethylene glycols and fatty acid esters of sorbitan, and mixtures thereof.

Besides inert diluents, oral compositions can also include adjuvants such as wetting agents, emulsifying and suspending agents, sweetening, flavoring, coloring, perfuming and preservative agents.

Suspensions, in addition to active compounds, may contain suspending agents as, for example, ethoxylated isostearyl alcohols, polyoxyethylene sorbitol and sorbitan esters, microcrystalline cellulose, aluminum metahydroxide, bentonite, agar-agar and tragacanth, and mixtures thereof.

The pharmaceutical compositions of this disclosure may also be administered in the form of suppositories for rectal administration. These compositions can be prepared by mixing a compound of this disclosure with a suitable non-irritating excipient, which is solid at room temperature but liquid at the rectal temperature and therefore will melt in the rectum to release the active components. Such materials include, but are not limited to, cocoa butter, beeswax and polyethylene glycols.

Topical administration of the pharmaceutical compositions of this disclosure is especially useful when the desired treatment involves areas or organs readily accessible by topical application. For application topically to the skin, the pharmaceutical composition should be formulated with a suitable ointment containing the active components suspended or dissolved in a carrier. Carriers for topical administration of the compounds of this disclosure include, but are not limited to, mineral oil, liquid petroleum, white petroleum, propylene glycol, polyoxyethylene polyoxypropylene compound, emulsifying wax and water. Alternatively, the pharmaceutical composition can be formulated with a suitable lotion or cream containing the active compound suspended or dissolved in a carrier. Suitable carriers include, but are not limited to, mineral oil, sorbitan monostearate, polysorbate 60, cetyl esters wax, cetearyl alcohol, 2-octyldodecanol, benzyl alcohol and water. The pharmaceutical compositions of this disclosure may also be topically applied to the lower intestinal tract by rectal suppository formulation or in a suitable enema formulation. Topically-administered transdermal patches are also included in this disclosure.

The pharmaceutical compositions of this disclosure may be administered by nasal aerosol or inhalation. Such compositions are prepared according to techniques well-known in the art of pharmaceutical formulation and may be prepared as solutions in saline, employing benzyl alcohol or other suitable preservatives, absorption promoters to enhance bioavailability, fluorocarbons, and/or other solubilizing or dispersing agents known in the art.

For ophthalmic use, the pharmaceutical compositions may be formulated as micronized suspensions in isotonic, pH adjusted sterile saline, or, preferably, as solutions in isotonic, pH adjusted sterile saline, either with or without a preservative such as benzylalkonium chloride. Alternatively, for ophthalmic uses, the pharmaceutical compositions may be formulated in an ointment such as petrolatum.

Transdermal patches have the added advantage of providing controlled delivery of a compound of the present disclosure to the body. Dissolving or dispersing the compound in the proper medium can make such dosage forms. Absorption enhancers can also be used to increase the flux of the compound across the skin. Either providing a rate controlling membrane or dispersing the compound in a polymer matrix or gel can control the rate of such flux.

Examples of suitable aqueous and nonaqueous carriers, which may be employed in the pharmaceutical compositions of the disclosure, include water, ethanol, polyols (such as glycerol, propylene glycol, polyethylene glycol, and the like), and suitable mixtures thereof, vegetable oils, such as olive oil, and injectable organic esters, such as ethyl oleate. Proper fluidity can be maintained, for example, by the use of coating materials, such as lecithin, by the maintenance of the required particle size in the case of dispersions, and by the use of surfactants.

Such compositions may also contain adjuvants such as preservatives, wetting agents, emulsifying agents and dispersing agents. Inclusion of one or more antibacterial and/or antifungal agents, for example, paraben, chlorobutanol, phenol sorbic acid, and the like, may be desirable in certain embodiments. It may alternatively or additionally be desirable to include isotonic agents, such as sugars, sodium chloride, and the like into the compositions. In addition, prolonged absorption of the injectable pharmaceutical form may be brought about by the inclusion of agents, which delay absorption such as aluminum monostearate and gelatin.

In certain embodiments, a described compound or pharmaceutical preparation is administered orally. In other embodiments, a described compound or pharmaceutical preparation is administered intravenously. Alternative routes of administration include sublingual, intramuscular, and transdermal administrations.

When compounds described herein are administered as pharmaceuticals, to humans and animals, they can be given per se or as a pharmaceutical composition containing, for example, 0.1% to 99.5% (more preferably, 0.5% to 90%) of active ingredient in combination with a pharmaceutically acceptable carrier.

Preparations described herein may be given orally, parenterally, topically, or rectally. They are of course given in forms suitable for the relevant administration route. For example, they are administered in tablets or capsule form, by injection, inhalation, eye lotion, ointment, suppository, etc. administration by injection, infusion or inhalation; topical by lotion or ointment; and rectal by suppositories. Oral administrations are preferred.

Such compounds may be administered to humans and other animals for therapy by any suitable route of administration, including orally, nasally, as by, for example, a spray, rectally, intravaginally, parenterally, intracisternally and topically, as by powders, ointments or drops, including buccally and sublingually.

Regardless of the route of administration selected, compounds described herein which may be used in a suitable hydrated form, and/or the pharmaceutical compositions of the present disclosure, are formulated into pharmaceutically-acceptable dosage forms by conventional methods known to those of skill in the art.

Actual dosage levels of the active ingredients in the pharmaceutical compositions of the disclosure may be varied so as to obtain an amount of the active ingredient that is effective to achieve the desired therapeutic response for a particular patient, composition, and mode of administration, without being toxic to the patient.

The terms "administration of" and or "administering" should be understood to mean providing a pharmaceutical composition in a therapeutically effective amount to the subject in need of treatment. Administration routes can be enteral, topical or parenteral. As such, administration routes include but are not limited to intracutaneous, subcutaneous, intravenous, intraperitoneal, intraarterial, intrathecal, intracapsular, intraorbital, intracardiac, intradermal, transdermal, transtracheal, subcuticular, intraarticular, subcapsular, subarachnoid, intraspinal and intrasternal, oral, sublingual buccal, rectal, vaginal, nasal ocular administrations, as well infusion, inhalation, and nebulization.

The term "cancer" refers to a group diseases characterized by abnormal and uncontrolled cell proliferation starting at one site (primary site) with the potential to invade and to spread to others sites (secondary sites, metastases) which differentiate cancer (malignant tumor) from benign tumor. Virtually all the organs can be affected, leading to more than 100 types of cancer that can affect humans. Cancers can result from many causes including genetic predisposition, viral infection, exposure to ionizing radiation, exposure environmental pollutant, tobacco and or alcohol use, obesity, poor diet, lack of physical activity or any combination thereof.

Exemplary cancers described by the national cancer institute include: Acute Lymphoblastic Leukemia, Adult; Acute Lymphoblastic Leukemia, Childhood; Acute Myeloid Leukemia, Adult; Adrenocortical Carcinoma; Adrenocortical Carcinoma, Childhood; AIDS-Related Lymphoma; AIDS-Related Malignancies; Anal Cancer; Astrocytoma, Childhood Cerebellar; Astrocytoma, Childhood Cerebral; Bile Duct Cancer, Extrahepatic; Bladder Cancer; Bladder Cancer, Childhood; Bone Cancer, Osteosarcoma/Malignant Fibrous Histiocytoma; Brain Stem Glioma, Childhood; Brain Tumor, Adult; Brain Tumor, Brain Stem Glioma, Childhood; Brain Tumor, Cerebellar Astrocytoma, Childhood; Brain Tumor, Cerebral Astrocytoma/Malignant Glioma, Childhood; Brain Tumor, Ependymoma, Childhood; Brain Tumor, Medulloblastoma, Childhood; Brain Tumor, Supratentorial Primitive Neuroectodermal Tumors, Childhood; Brain Tumor, Visual Pathway and Hypothalamic Glioma, Childhood; Brain Tumor, Childhood (Other); Breast Cancer; Breast Cancer and Pregnancy; Breast Cancer, Childhood; Breast Cancer, Male; Bronchial Adenomas/Carcinoids, Childhood: Carcinoid Tumor, Childhood; Carcinoid Tumor, Gastrointestinal; Carcinoma, Adrenocortical; Carcinoma, Islet Cell; Carcinoma of Unknown Primary; Central Nervous System Lymphoma, Primary; Cerebellar Astrocytoma, Childhood; Cerebral Astrocytoma/Malignant Glioma, Childhood; Cervical Cancer; Childhood Cancers; Chronic Lymphocytic Leukemia; Chronic Myelogenous Leukemia; Chronic Myeloproliferative Disorders; Clear Cell Sarcoma of Tendon Sheaths; Colon Cancer; Colorectal Cancer, Childhood; Cutaneous T-Cell Lymphoma; Endometrial Cancer; Ependymoma, Childhood; Epithelial Cancer, Ovarian; Esophageal Cancer; Esophageal Cancer, Childhood; Ewing's Family of Tumors; Extracranial Germ Cell Tumor, Childhood; Extragonadal Germ Cell Tumor; Extrahepatic Bile Duct Cancer; Eye Cancer, Intraocular Melanoma; Eye Cancer, Retinoblastoma; Gallbladder Cancer; Gastric (Stomach) Cancer; Gastric (Stomach) Cancer, Childhood; Gastrointestinal Carcinoid Tumor; Germ Cell Tumor, Extracranial, Childhood; Germ Cell Tumor, Extragonadal; Germ Cell Tumor, Ovarian; Gestational Trophoblastic Tumor; Glioma. Childhood Brain Stem; Glioma. Childhood Visual Pathway and Hypothalamic; Hairy Cell Leukemia; Head and Neck Cancer; Hepatocellular (Liver) Cancer, Adult (Primary); Hepatocellular (Liver) Cancer, Childhood (Primary); Hodgkin's Lymphoma, Adult; Hodgkin's Lymphoma, Childhood; Hodgkin's Lymphoma During Pregnancy; Hypopharyngeal Cancer; Hypothalamic and Visual Pathway Glioma, Childhood; Intraocular Melanoma; Islet Cell Carcinoma (Endocrine Pancreas); Kaposi's Sarcoma; Kidney Cancer; Laryngeal Cancer; Laryngeal Cancer, Childhood; Leukemia, Acute Lymphoblastic, Adult; Leukemia, Acute Lymphoblastic, Childhood; Leukemia, Acute Myeloid, Adult; Leukemia, Acute Myeloid, Childhood; Leukemia, Chronic Lymphocytic; Leukemia, Chronic Myelogenous; Leukemia, Hairy Cell; Lip and Oral Cavity Cancer; Liver Cancer, Adult (Primary); Liver Cancer, Childhood (Primary); Lung Cancer, Non-Small Cell; Lung Cancer, Small Cell; Lymphoblastic Leukemia, Adult Acute; Lymphoblastic Leukemia, Childhood Acute; Lymphocytic Leukemia, Chronic; Lymphoma, AIDS—Related; Lymphoma, Central Nervous System (Primary); Lymphoma, Cutaneous T-Cell; Lymphoma, Hodgkin's, Adult; Lymphoma, Hodgkin's; Childhood; Lymphoma, Hodgkin's During Pregnancy; Lymphoma, Non-Hodgkin's, Adult; Lymphoma, Non-Hodgkin's, Childhood; Lymphoma, Non-Hodgkin's During Pregnancy; Lymphoma, Primary Central Nervous System; Macroglobulinemia, Waldenstrom's; Male Breast Cancer; Malignant Mesothelioma, Adult; Malignant Mesothelioma, Childhood; Malignant Thymoma; Medulloblastoma, Childhood; Melanoma; Melanoma, Intraocular; Merkel Cell Carcinoma; Mesothelioma, Malignant; Metastatic Squamous Neck Cancer with Occult Primary; Multiple Endocrine Neoplasia Syndrome, Childhood; Multiple Myeloma/Plasma Cell Neoplasm; Mycosis Fungoides; Myelodysplasia Syndromes; Myelogenous Leukemia, Chronic; Myeloid Leukemia, Childhood Acute; Myeloma, Multiple; Myeloproliferative Disorders, Chronic; Nasal Cavity and Paranasal Sinus Cancer; Nasopharyngeal Cancer; Nasopharyngeal Cancer, Childhood; Neuroblastoma; Non-Hodgkin's Lymphoma, Adult; Non-Hodgkin's Lymphoma, Childhood; Non-Hodgkin's Lymphoma During Pregnancy; Non-Small Cell Lung Cancer; Oral Cancer, Childhood; Oral Cavity and Lip Cancer; Oropharyngeal Cancer; Osteosarcoma/Malignant Fibrous Histiocytoma of Bone; Ovarian Cancer, Childhood; Ovarian Epithelial Cancer; Ovarian Germ Cell Tumor; Ovarian Low Malignant Potential Tumor; Pancreatic Cancer; Pancreatic Cancer, Childhood', Pancreatic Cancer, Islet Cell; Paranasal Sinus and Nasal Cavity Cancer; Parathyroid Cancer; Penile Cancer; Pheochromocytoma; Pineal and Supratentorial Primitive Neuroectodermal Tumors, Childhood; Pituitary Tumor; Plasma Cell Neoplasm/Multiple Myeloma; Pleuropulmonary Blastoma; Pregnancy and Breast Cancer; Pregnancy and Hodgkin's Lymphoma; Pregnancy and Non-Hodgkin's Lymphoma; Primary Central Nervous System Lymphoma; Primary Liver Cancer, Adult; Primary Liver Cancer, Childhood; Prostate Cancer; Rectal Cancer; Renal Cell (Kidney) Cancer; Renal Cell Cancer, Childhood; Renal Pelvis and Ureter, Transitional Cell Cancer; Retinoblastoma; Rhabdomyosarcoma, Childhood; Salivary Gland Cancer; Salivary Gland'Cancer, Childhood; Sarcoma, Ewing's Family of Tumors; Sarcoma, Kaposi's; Sarcoma (OsteosarcomaVMalignant Fibrous Histiocytoma of Bone; Sarcoma, Rhabdomyosarcoma, Childhood; Sarcoma, Soft Tissue, Adult; Sarcoma, Soft Tissue, Childhood; Sezary Syndrome; Skin Cancer; Skin Cancer, Childhood; Skin Cancer (Melanoma); Skin Carcinoma, Merkel Cell; Small Cell Lung Cancer; Small Intestine Cancer; Soft Tissue Sarcoma, Adult; Soft Tissue Sarcoma, Childhood; Squamous Neck Cancer with Occult Primary, Metastatic; Stomach (Gastric) Cancer; Stomach (Gastric) Cancer, Childhood; Supratentorial Primitive Neuroectodermal Tumors, Childhood; T-Cell Lymphoma, Cutaneous; Testicular Cancer; Thymoma, Childhood; Thymoma, Malignant; Thyroid Cancer; Thyroid Cancer, Childhood; Transitional Cell Cancer of the Renal Pelvis and Ureter; Trophoblastic Tumor, Gestational; Unknown Primary Site, Cancer of, Childhood; Unusual Cancers of Childhood; Ureter and Renal Pelvis, Transitional Cell Cancer; Urethral Cancer; Uterine Sarcoma; Vaginal Cancer; Visual Pathway and Hypothalamic Glioma, Childhood; Vulvar Cancer; Waldenstrom's Macro globulinemia; and Wilms' Tumor.

In certain aspects, cancer include Lung cancer, Breast cancer, Colorectal cancer, Prostate cancer, Stomach cancer, Liver cancer, cervical cancer, Esophageal cancer, Bladder cancer, Non-Hodgkin lymphoma, Leukemia, Pancreatic cancer, Kidney cancer, endometrial cancer, Head and neck cancer, Lip cancer, oral cancer, Thyroid cancer, Brain cancer, Ovary cancer, Melanoma, Gallbladder cancer, Laryngeal cancer, Multiple myeloma, Nasopharyngeal cancer, Hodgkin lymphoma, Testis cancer and Kaposi sarcoma.

In certain aspects, the method further includes administering a chemotherapeutic agent. The compounds of the disclosure can be administered in combination with one or more additional therapeutic agents. The phrases "combination therapy", "combined with" and the like refer to the use of more than one medication or treatment simultaneously to increase the response. The FGFR inhibitor of the present disclosure might for example be used in combination with other drugs or treatment in use to treat cancer. In various aspect, the compound is administered prior to, simultaneously with or following the administration of the chemotherapeutic agent.

The term "anti-cancer therapy" refers to any therapy or treatment that can be used for the treatment of a cancer. Anti-cancer therapies include, but are not limited to, surgery, radiotherapy, chemotherapy, immune therapy and targeted therapies.

Examples of chemotherapeutic agents or anti-cancer agents include, but are not limited to, Actinomycin, Azacitidine, Azathioprine, Bleomycin, Bortezomib, Carboplatin, Capecitabine, Cisplatin, Chlorambucil, Cyclophosphamide, Cytarabine, Daunorubicin, Docetaxel, Doxifluridine, Doxorubicin, Epirubicin, Epothilone, Etoposide, Fiuorouracil, Gemcitabine, Hydroxyurea, Idarubicin, Imatinib, lrinotecan, Mechlorethamine, Mercaptopurine, Methotrexate, Mitoxantrone, Oxaliplatin, Paclitaxel, Pemetrexed, Teniposide, Tioguanine, Topotecan, Valrubicin, Vinblastine, Vincristine, Vindesine, Vinorelbine, panitumamab, Erbitux (cetuximab), matuzumab, IMC-IIF 8, TheraCIM hR3, denosumab, Avastin (bevacizumab), Humira (adalimumab), Herceptin (trastuzumab), Remicade (infliximab), rituximab, Synagis (palivizumab), Mylotarg (gemtuzumab oxogamicin), Raptiva (efalizumab), Tysabri (natalizumab), Zenapax (daclizimab), NeutroSpec (Technetium (99mTc) fanolesomab), tocilizumab, ProstaScint (Indium-Ill labeled Capromab Pendetide), Bexxar (tositumomab), Zevalin (ibritumomab tiuxetan (IDEC-Y2B8) conjugated to yttrium 90), Xolair (omalizumab), MabThera (Rituximab), ReoPro (abciximab), MabCampath (alemtuzumab), Simulect (basiliximab), LeukoScan (sulesomab), CEA-Scan (arcitumomab), Verluma (nofetumomab), Panorex (Edrecolomab), alemtuzumab, CDP 870, natalizumab Gilotrif (afatinib), Lynparza (olaparib), Perjeta (pertuzumab), Otdivo (nivolumab), Bosulif (bosutinib), Cabometyx (cabozantinib), Ogivri (trastuzumab-dkst), Sutent (sunitinib malate), Adcetris (brentuximab vedotin), Alecensa (alectinib), Calquence (acalabrutinib), Yescarta (ciloleucel), Verzenio (abemaciclib), Keytruda (pembrolizumab), Aliqopa (copanlisib), Nerlynx (neratinib), Imfinzi (durvalumab), Darzalex (daratumumab), Tecentriq (atezolizumab), and Tarceva (erlotinib). Examples of immunotherapeutic agent include, but are not limited to, interleukins (Il-2, Il-7, Il-12), cytokines (Interferons, G-CSF, imiquimod), chemokines (CCL3, CC126, CXCL7), immunomodulatory imide drugs (thalidomide and its analogues).

In a further embodiment, the disclosure provides a method of inhibiting a kinase activity including contacting a cell with a compound of Formula (I), Formula (II), or Formula (III). In one aspect, the kinase is selected from the group consisting of ALK, EGFR, EPH-B3, FAK, FGFR1, FGFR2, FGFR3, FGFR4, KIT, MEK1, MET, PDGFR-AL- PHA, PDGFR-BETA, RET, ROS and TYRO 3. In certain aspects, the kinase is FGFR1, FGFR2, FGFR3 and/or FGFR4. In another aspect, the kinase is FGFR4. In various aspects, the cell is a cancer cell. In many aspects, the cancer cell is a breast, lung, bladder, prostate, ovarian, endometrial, rhabdomyosarcoma, liver or gastric cancer cell.

Referring to FIG. 1, the FGFR4 kinase contains a cysteine (Cys552) located near the ATP-binding site, in the hinge region of the receptor, which is unique within the FGFR family and rare among other kinases. Covalent inhibitors of FGFR4 kinase afford potent and selective inhibition of FGFRs by covalently targeting a thiol group (SH) in the cysteine residue.

The screening method employed in the current disclosure according to some embodiments is described as following. Screen probes against live cells or live animals can include the step of (1) treatment of live cells with an electrophilic probe leads to the covalent linkage between target proteins and the probe; (2) lyse cells; (3) add biotin-azide to conjugate biotin to probe-modified proteins via the Copper-Catalyzed Azide-Alkyne Cycloaddition (CuAAC) click reaction; (4) use streptavidin resin to pull down and enrich biotin-conjugated proteins; (5) digest resin-bound proteins with trypsin; (6) analyze resulting tryptic peptides with liquid chromatography-mass spectrometry (LC-MS) or MS; (7) obtain information on identity of target proteins as well as strength of probe-target interaction in cells. The target confirmation and selection can include the steps of (1) use orthogonal methods such as western blots to confirm that the identified proteins indeed bind to the probe; and (2) select the most disease-relevant target-lead pairs for further preclinical and clinical studies.

Presented below are examples discussing the design and evaluation of efficacy of new pyridinylpyrimidine-based FGFR inhibitors, contemplated for the discussed applications. The following examples are provided to further illustrate the embodiments of the present disclosure, but are not intended to limit the scope of the disclosure. While they are typical of those that might be used, other procedures, methodologies, or techniques known to those skilled in the art may alternatively be used.

EXAMPLES

Example 1

Synthesis and Characterization of the Pyridinylpyrimidine-Based FGFR Inhibitors (Compounds 1-4)

Scheme 1. Synthesis of compound 1.

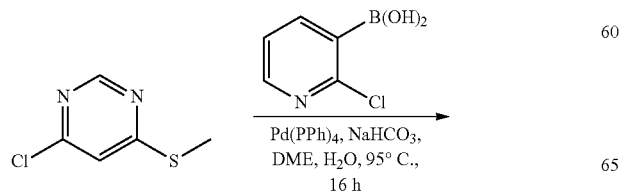

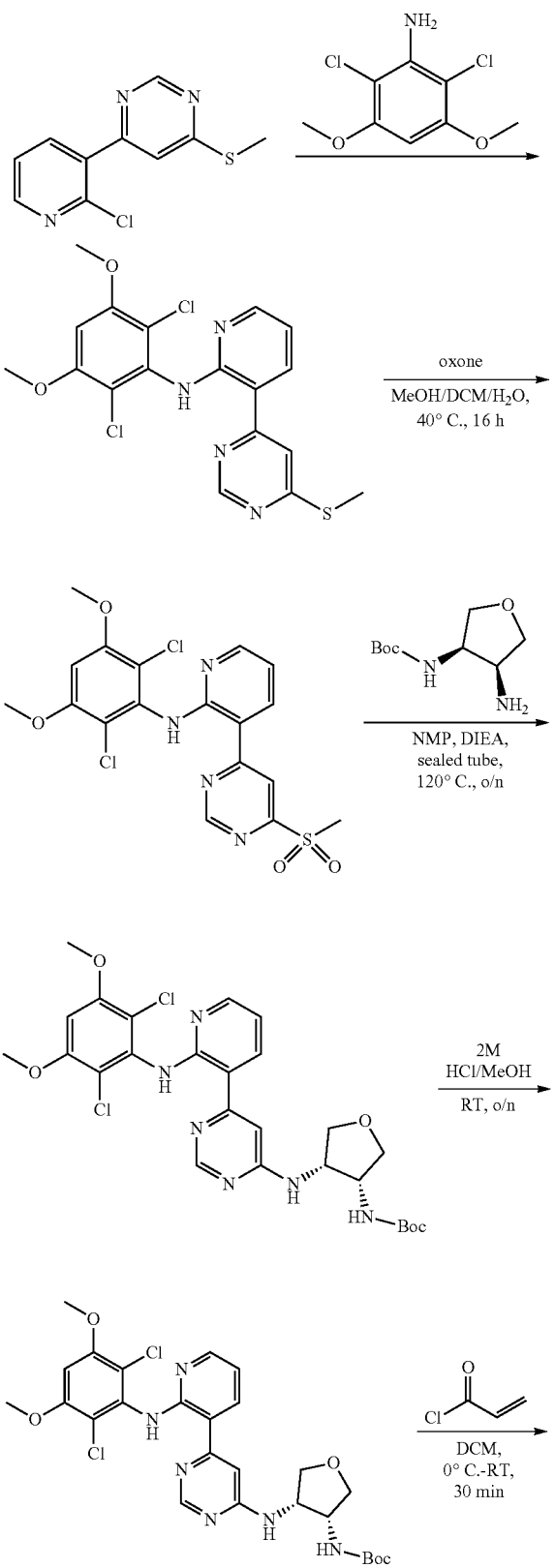

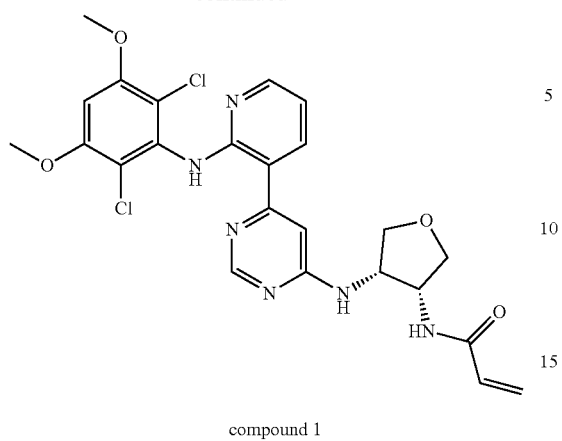
compound 1
Compound 1 was synthesized based on synthetic scheme 1.
Scheme 2. Synthesis of compound 2.
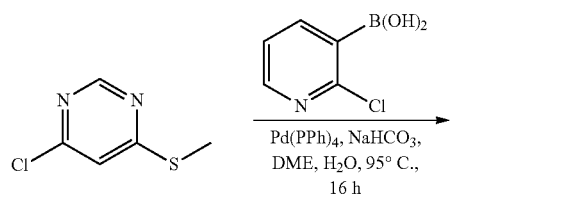
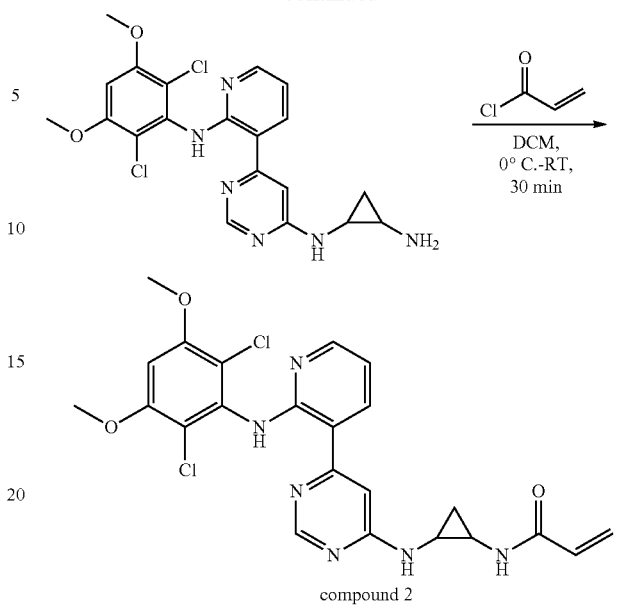
compound 2
Compound 2 was synthesized based on synthetic scheme 2.
Scheme 3. Synthesis of compound 3.
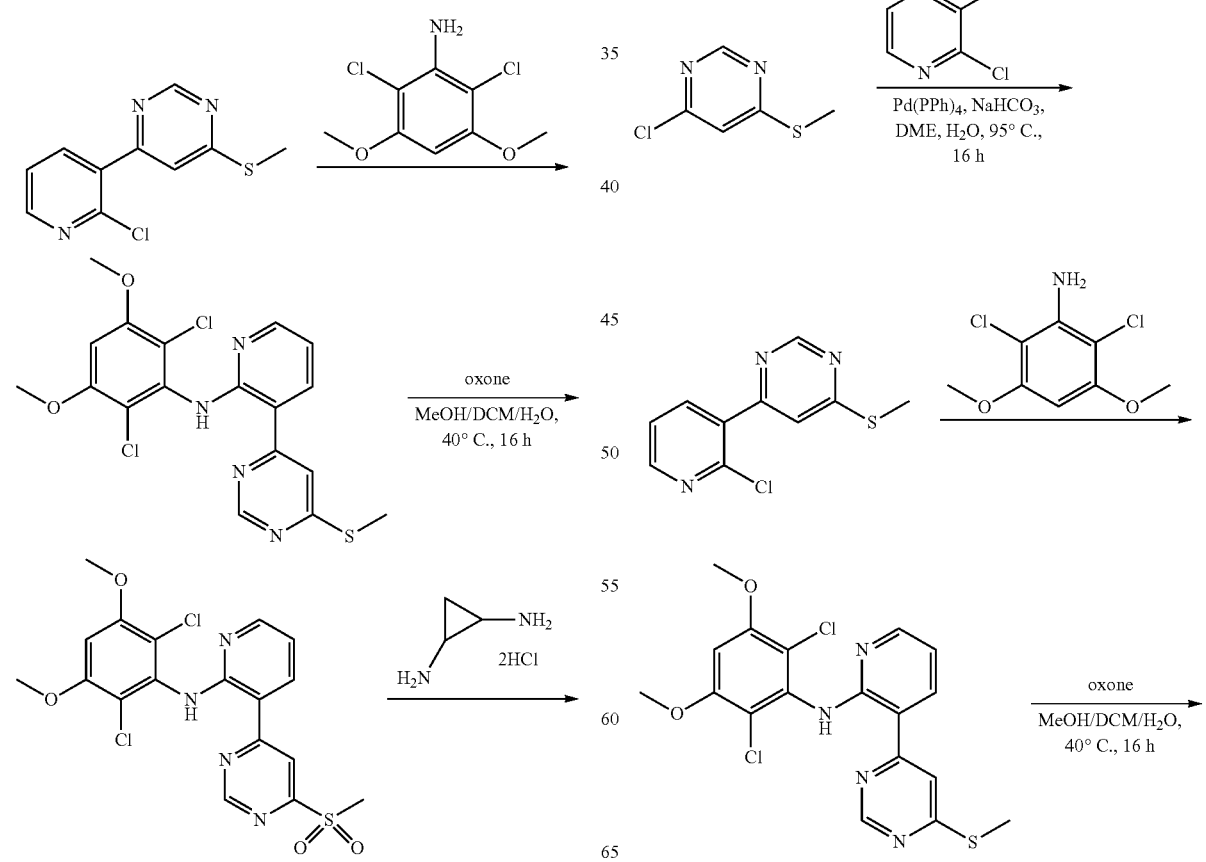

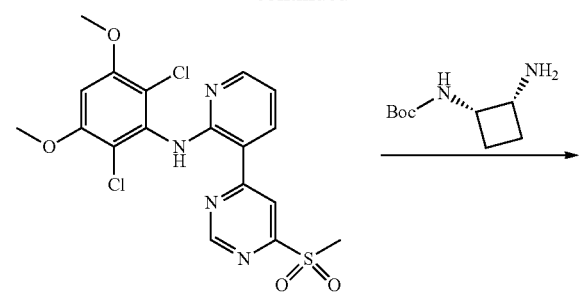
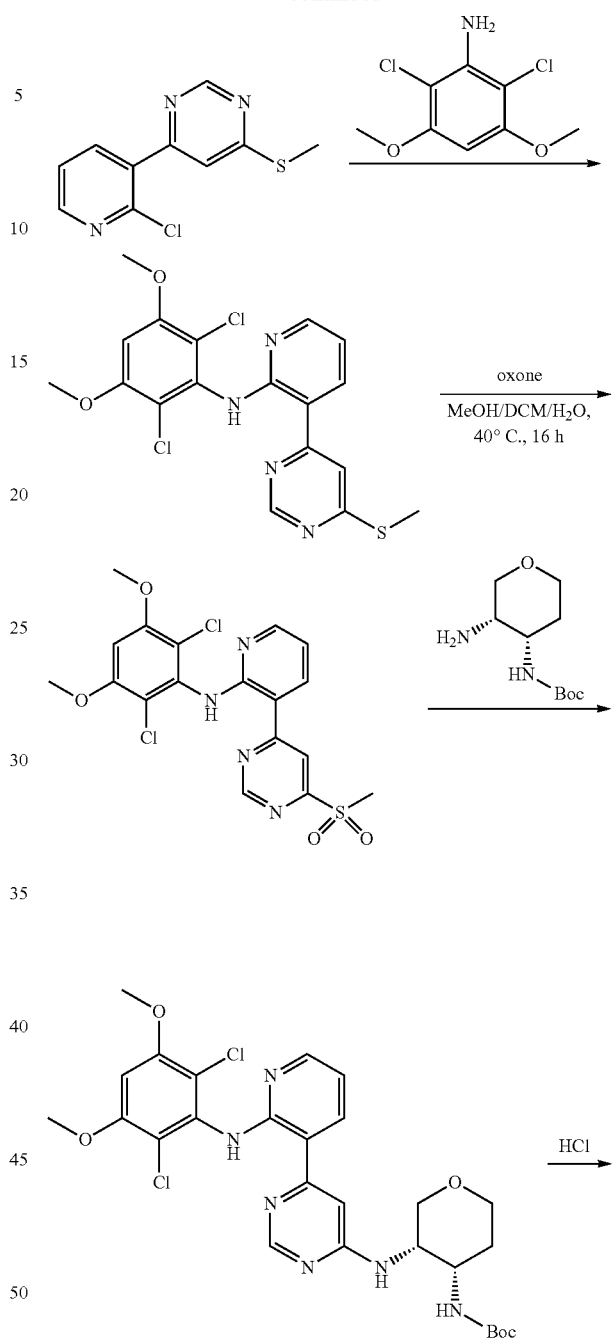
Compound 3 was synthesized based on synthetic scheme 3.
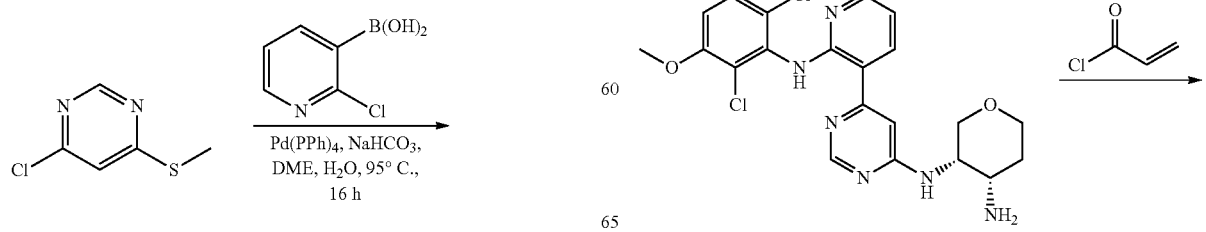
Scheme 4. Synthesis of compound 4.

-continued
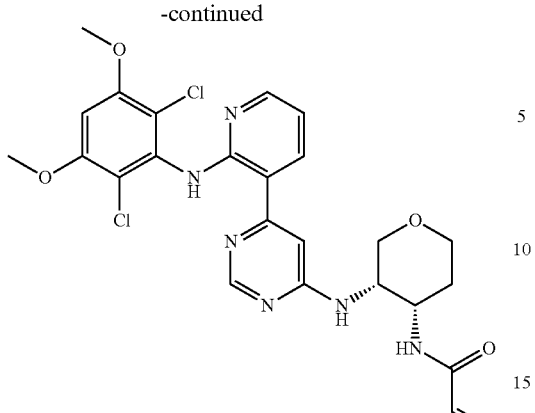
compound 4
Compound 4 was synthesized based on synthetic scheme 4.
Example 2
Synthesis of Compound 6
(N-[2-[[6-[2-(2,6-dichloro-3,5-dimethoxy-anilino)-3-pyridyl]pyrimidin-4-yl]amino]-5-(1-methylazetidin-3-yl)oxy-phenyl]prop-2-enamide)
Scheme 5. Synthesis of compound 6.
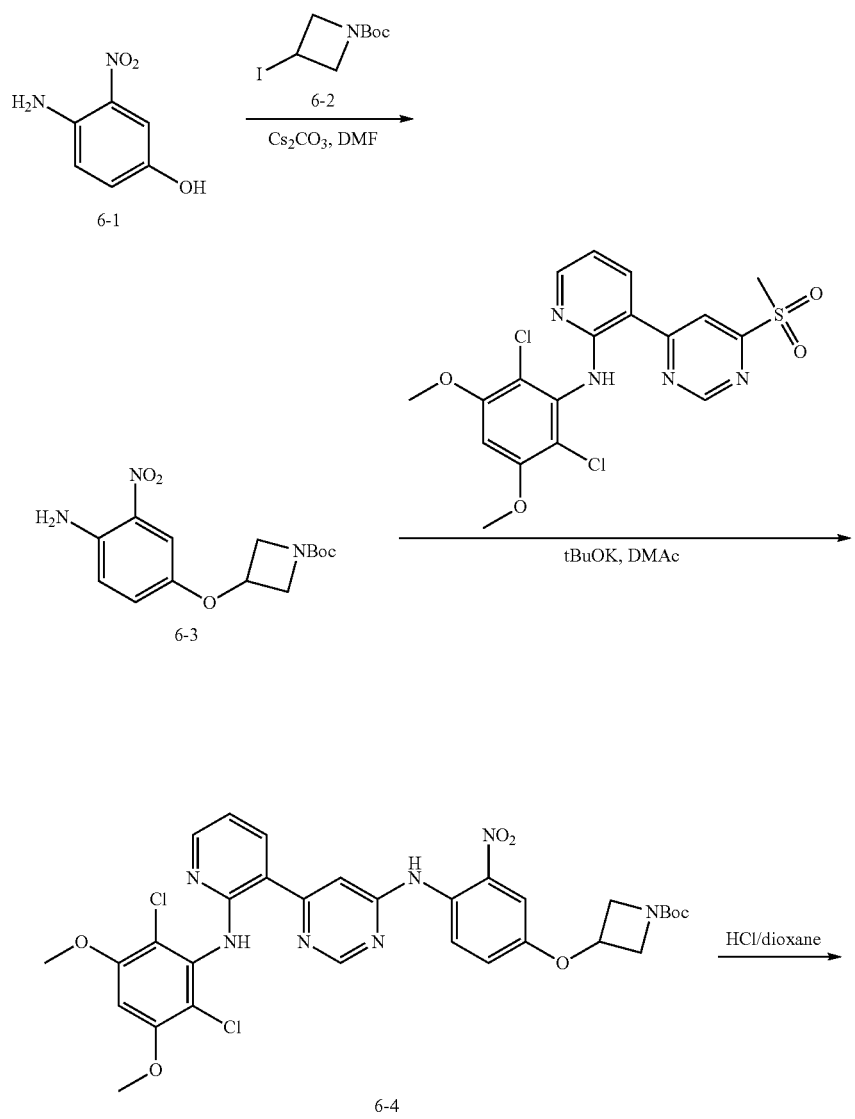

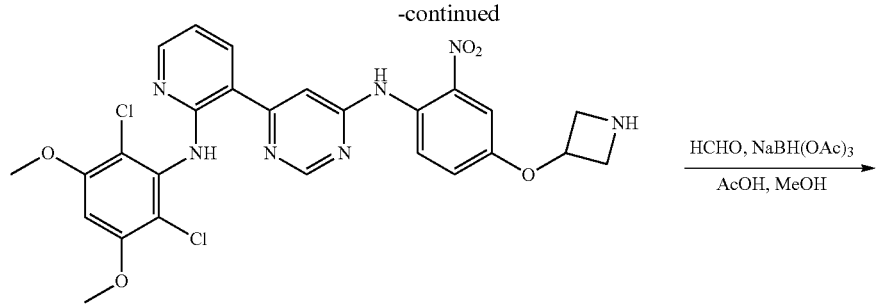
6-5
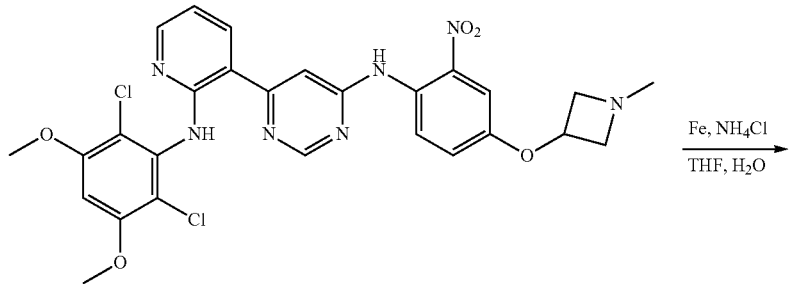
6-6
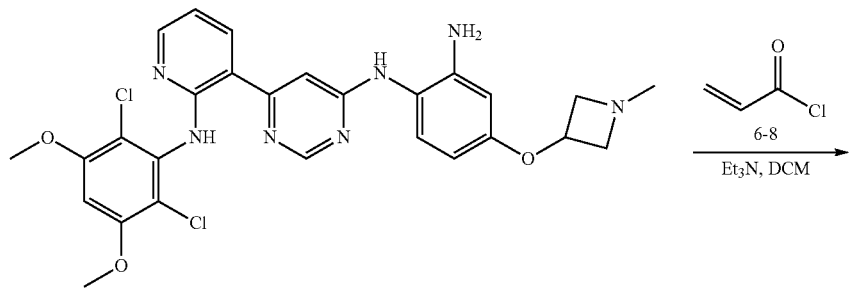
6-7
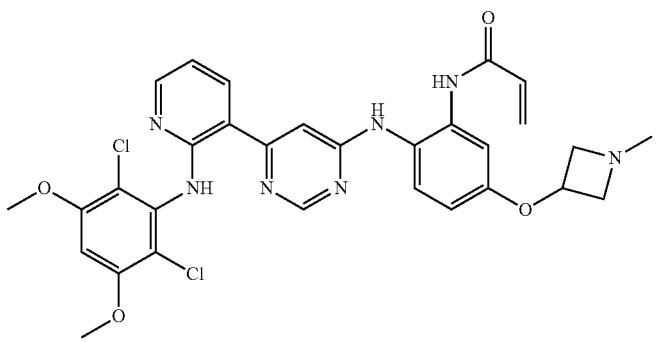
compound 6
Compound 6 was synthesized based on synthetic scheme 5. The synthetic process for each of the step is described as below.
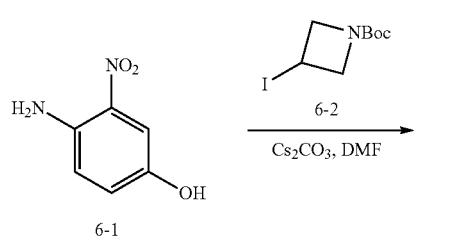
6-1
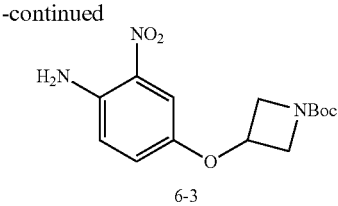
6-3
Step 1 to synthesize compound 6: A solution of 4-amino-3-nitro-phenol (3 g, 19.46 mmol), tert-butyl 3-iodoazetidine-1-carboxylate (6.06 g, 21.41 mmol), Cs₂CO₃ (9.51 g, 29.20 mmol) in DMF (60 mL) was stirred at 90° C. for 16 hours under N₂ atmosphere. The mixture was diluted with water (5 mL), extracted with EtOAc (10 mL×3), then the combined organic layers were washed with sat. aq. NaCl (5 mL×7), dried over Na$_2$SO$_4$, filtered and concentrated. The residue was purified by silica gel chromatography (PE/EtOAc=1/0 to 3/1) to afford tert-butyl 3-(4-amino-3-nitro-phenoxy)azetidine-1-carboxylate (5.4 g, 17.46 mmol, 90% yield) as a red solid. $^1$H NMR (400 MHz, DMSO-d$_6$): δ=7.28 (d, J=4.0 Hz, 1H), 7.18-7.14 (m, 2H), 7.02 (d, J=9.2 Hz, 1H), 4.97-4.92 (m, 1H), 4.26-4.23 (m, 2H), 3.79-3.76 (m, 2H), 1.38 (s, 9H).

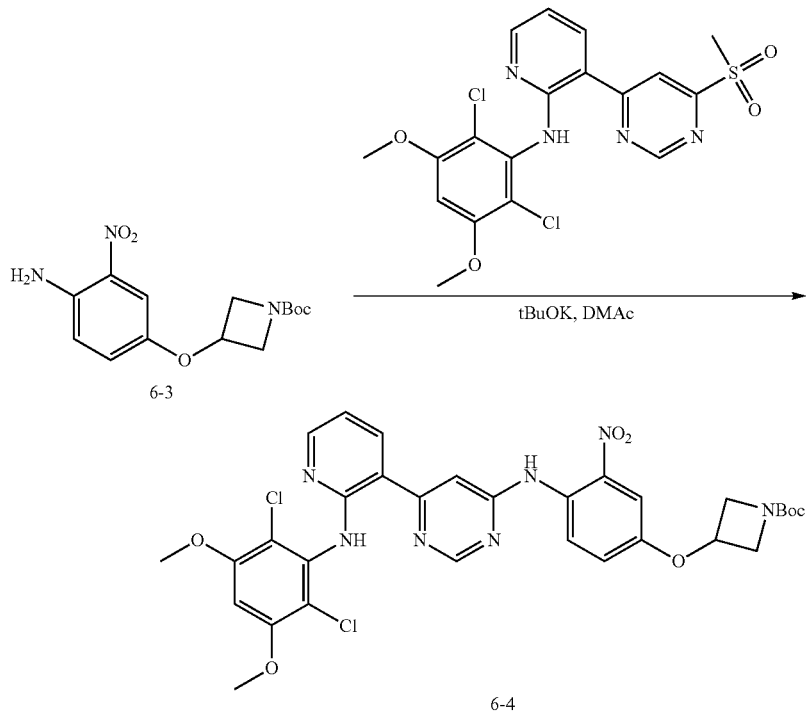 [SMILES: CC(C)(C)OC(=O)N1CC(Oc2ccc(N)c([N+](=O)[O-])c2)C1 ; COc1cc(OC)c(Cl)c(Nc2ncccc2-c2cc(S(C)(=O)=O)ncn2)c1Cl ; COc1cc(OC)c(Cl)c(Nc2ncccc2-c2cc(Nc3ccc(OC4CN(C(=O)OC(C)(C)C)C4)cc3[N+](=O)[O-])ncn2)c1Cl]

Step 2 to synthesize compound 6: To a solution of N-(2,6-dichloro-3,5-dimethoxy-phenyl)-3-(6-methylsulfonylpyrimidin-4-yl)pyridin-2-amine (800 mg, 1.76 mmol), tert-butyl 3-(4-amino-3-nitro-phenoxy)azetidine-1-carboxylate (652 mg, 2.11 mmol) in DMAc (15 mL) was added t-BuOK (595 mg, 5.31 mmol). The mixture was stirred at 45° C. for 2 hours. The mixture was diluted with water (20 mL), extracted with EtOAc (30 mL×3), then the combined organic layers were washed with sat. aq. NaCl (20 mL×7), dried over Na$_2$SO$_4$, filtered and concentrated. The residue was purified by silica gel chromatography (PE/EtOAc=1/0 to 3/1) to afford tert-butyl 3-[4-[[6-[2-(2,6-dichloro-3,5-dimethoxy-anilino)-3-pyridyl]pyrimidin-4-yl]amino]-3-nitro-phenoxy]azetidine-1-carboxylate (648 mg, 0.947 mmol, 54% yield) as a yellow solid.

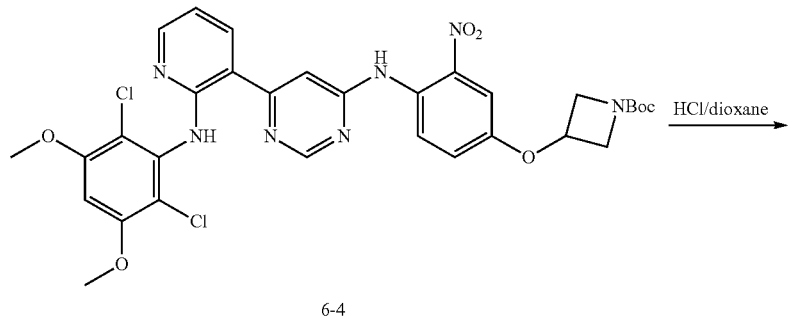

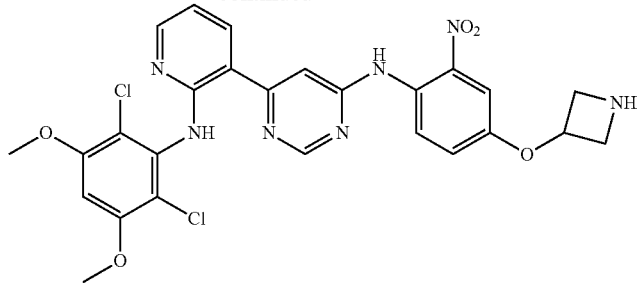

6-5

Step 3 to synthesize compound 6: To a solution of tert-butyl 3-[4-[[6-[2-(2,6-dichloro-3,5-dimethoxy-anilino)-3-pyridyl]pyrimidin-4-yl]amino]-3-nitro-phenoxy]azetidine-1-carboxylate (648 mg, 0.947 mmol) in dioxane (10 mL) was added HCl/dioxane (4 M, 2.37 mL). The mixture was stirred at 25° C. for 2 hours. The mixture was concentrated to afford N-[4-(azetidin-3-yloxy)-2-nitro-phenyl]-6-[2-(2,6-dichloro-3,5-dimethoxy-anilino)-3-pyridyl]pyrimidin-4-amine (550 mg, 0.886 mmol, 93% yield, HCl salt) as a yellow solid.

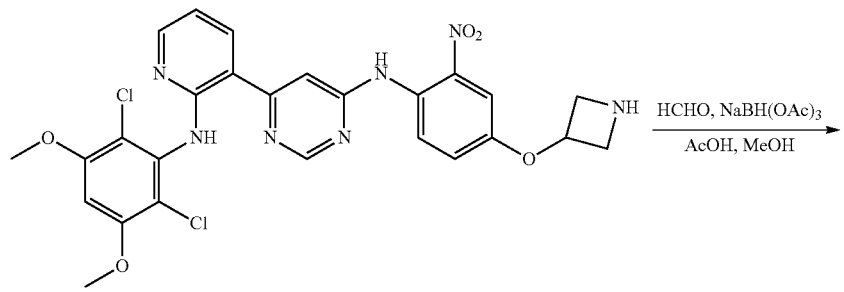

6-5

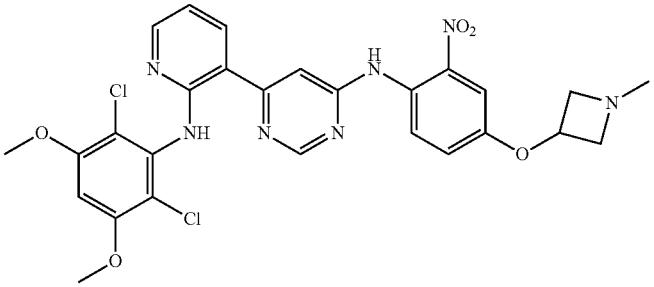

6-6

Step 4 to synthesize compound 6: To a solution of N-[4-(azetidin-3-yloxy)-2-nitro-phenyl]-6-[2-(2,6-dichloro-3,5-dimethoxy-anilino)-3-pyridyl]pyrimidin-4-amine (550 mg, 0.886 mmol, HCl salt) in MeOH (15 mL) was added aqueous HCHO (2.88 g, 35.43 mmol, 2.64 mL, 37% purity), NaBH(OAc)$_3$ (376 mg, 1.77 mmol), CH$_3$COOH (213 mg, 3.54 mmol). The mixture was stirred at 25° C. for 4 hours. The mixture was concentrated and the residue was purified by silica gel chromatography (DCM/MeOH=1/0 to 10/1) to afford 6-[2-(2,6-dichloro-3,5-dimethoxy-anilino)-3-pyridyl]-N-[4-(1-methylazetidin-3-yl)oxy-2-nitro-phenyl]pyrimidin-4-amine (450 mg, 0.752 mmol, 85% yield) as a red solid.

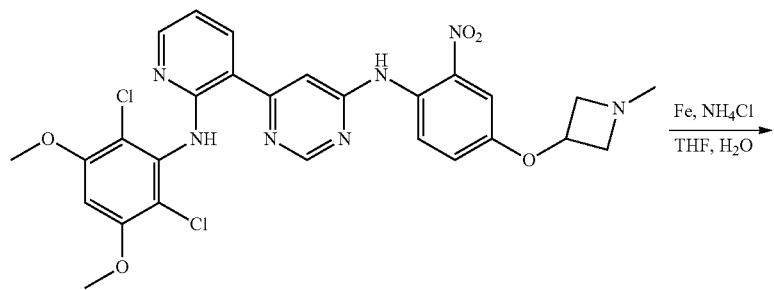

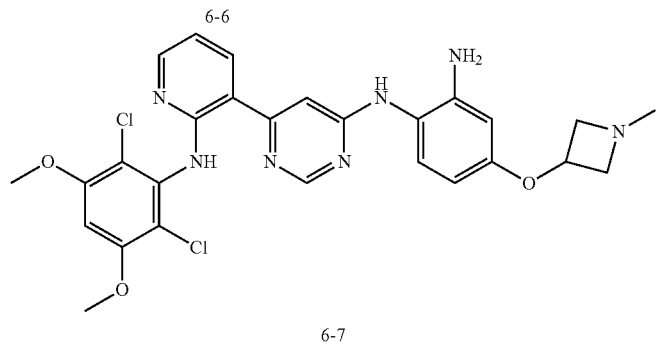

Step 5 to synthesize compound 6: To a solution of 6-[2-(2,6-dichloro-3,5-dimethoxy-anilino)-3-pyridyl]-N-[4-(1-methylazetidin-3-yl)oxy-2-nitro-phenyl]pyrimidin-4-amine (450 mg, 0.752 mmol) in THF (15 mL) and H₂O (15 mL) was added NH₄C₁ (201 mg, 3.76 mmol), Fe (210 mg, 3.76 mmol). The mixture was stirred at 65° C. for 4 hours. The mixture was filtered and the filtrate was concentrated to afford N₁-[6-[2-(2,6-dichloro-3,5-dimethoxy-anilino)-3-pyridyl]pyrimidin-4-yl]-4-(1-methylazetidin-3-yl)oxy-benzene-1,2-diamine (400 mg, 0.704 mmol, 93% yield) as a yellow solid.

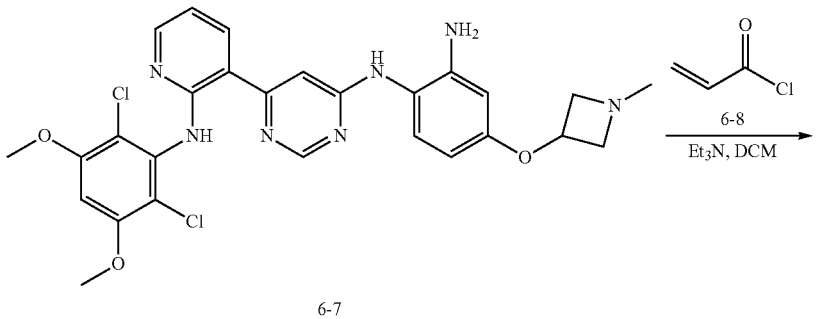

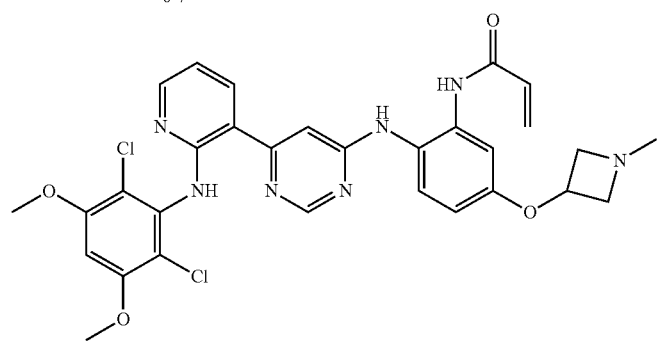

compound 6

Step 6 to synthesize compound 6: To a solution of N₁-[6-[2-(2,6-dichloro-3,5-dimethoxy-anilino)-3-pyridyl]pyrimidin-4-yl]-4-(1-methylazetidin-3-yl)oxy-benzene-1,2-diamine (200 mg, 0.352 mmol) in DCM (10 mL) was added Et₃N (36 mg, 0.352 mmol) and prop-2-enoyl chloride (32 mg, 0.352 mmol). The mixture was stirred at 25° C. for 0.5 hour. The mixture was diluted with water (10 mL), extracted with DCM (10 mL×3), then the combined organic layers were dried over Na$_2$SO$_4$, filtered and concentrated. The residue was purified by preparative HPLC (water (0.225% FA)-ACN) to afford N-[2-[[6-[2-(2,6-dichloro-3,5-dimethoxy-anilino)-3-pyridyl]pyrimidin-4-yl]amino]-5-(1-methylazetidin-3-yl)oxy-phenyl]prop-2-enamide (8.5 mg, 4% yield, 96% purity) as a white solid. LCMS: t$_R$=2.928 min in 0-60CD_4 min_Pos_220&254_Shimadzu.lcm, MS (ESI) m/z=622.2 [M+H]$^+$. $^1$H NMR (400 MHz, DMSO-d$_6$): δ=10.93 (s, 1H), 9.68 (s, 1H), 9.02 (s, 1H), 8.61 (s, 1H), 8.39 (s, 1H), 8.06-7.95 (m, 2H), 7.41-7.31 (m, 2H), 6.86-6.83 (m, 2H), 6.69-6.66 (m, 2H), 6.25 (d, J=2.0 Hz, 1H), 5.73-5.70 (m, 1H), 4.76-4.70 (m, 1H), 3.93 (s, 6H), 3.76-3.72 (m, 2H), 3.01-2.98 (m, 2H), 2.30 (s, 3H).

Example 3

Synthesis of Compound 7

N-[2-[[6-[2-(2,6-dichloro-3,5-dimethoxy-anilino)-3-pyridyl]pyrimidin-4-yl]amino]-5-[(1-methylazetidin-3-yl)methoxy]phenyl]prop-2-enamide Scheme 6. Synthesis of compound 7.

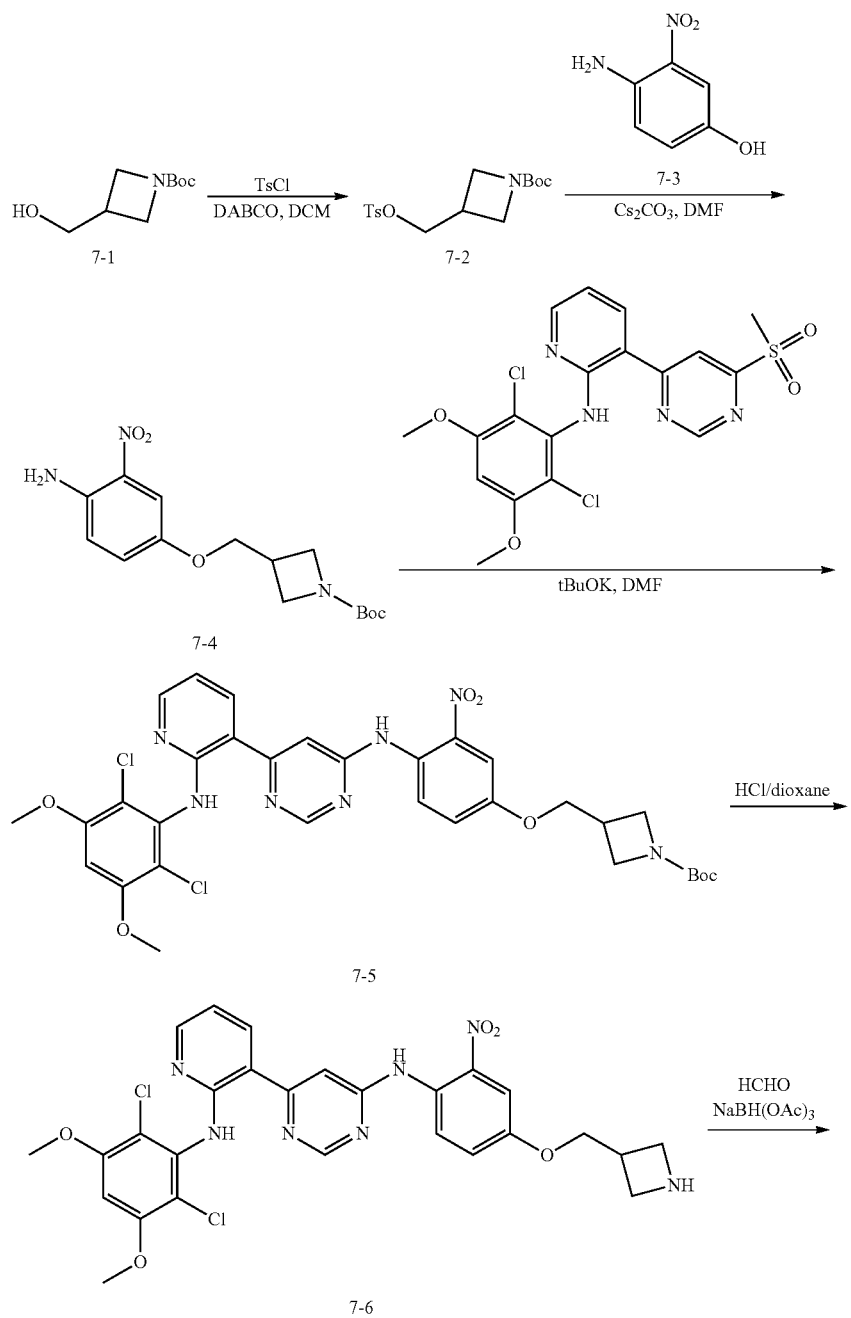

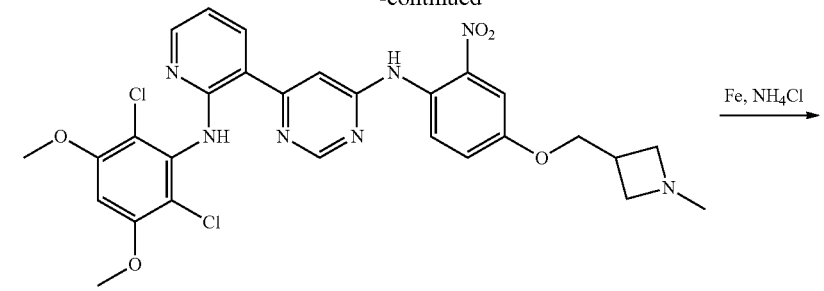

7-7

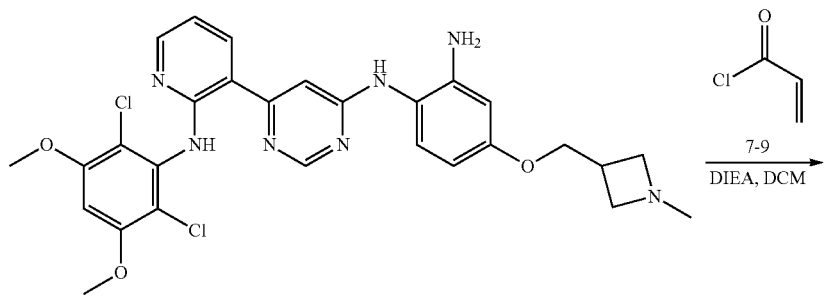

7-8

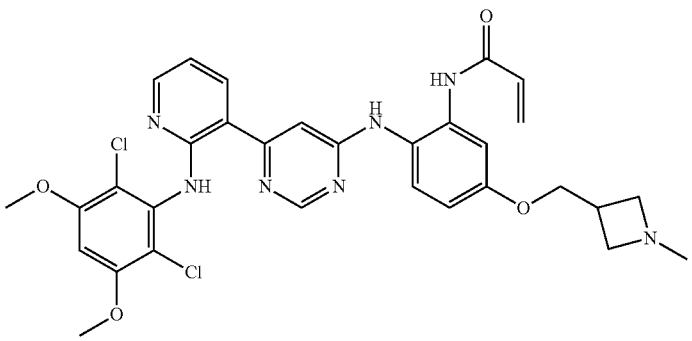

compound 7

Compound 7 was synthesized based on synthetic scheme 6. The synthetic process for each of the step is described as below.

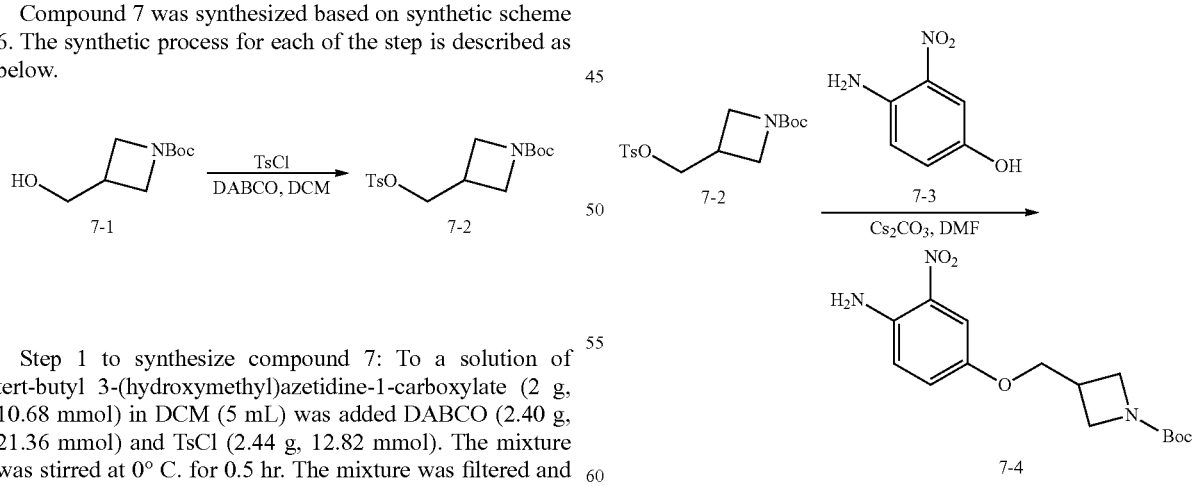

Step 1 to synthesize compound 7: To a solution of tert-butyl 3-(hydroxymethyl)azetidine-1-carboxylate (2 g, 10.68 mmol) in DCM (5 mL) was added DABCO (2.40 g, 21.36 mmol) and TsCl (2.44 g, 12.82 mmol). The mixture was stirred at 0° C. for 0.5 hr. The mixture was filtered and the filtrate was diluted with $H_2O$ (50 mL) and extracted with DCM (50 mL×3). The combined organic layers were washed with brine (50 mL), dried over $Na_2SO_4$, filtered and concentrated under reduced pressure to afford tert-butyl 3-(p-tolylsulfonyloxymethyl)azetidine-1-carboxylate (3 g, 8.79 mmol, 82% yield) as a colorless oil, which was used directly in the next step.

Step 2 to synthesize compound 7: To a solution of tert-butyl 3-(p-tolylsulfonyloxymethyl)azetidine-1-carboxylate (2 g, 5.86 mmol) in DMF (20 mL) was added $Cs_2CO_3$ (3.82 g, 11.72 mmol) and 4-amino-3-nitro-phenol (1.35 g, 8.79 mmol). The mixture was stirred at 80° C. for 12 hr. The mixture was quenched by addition of $H_2O$ (50 mL) at 25° C., and then diluted with H₂O (50 mL) and extracted with EtOAc (50 mL×3). The combined organic layers were washed with brine (50 mL), dried over Na₂SO₄, filtered and concentrated under reduced pressure to give a residue. After that the residue was purified by flash silica gel chromatography (ISCO®; 12 g SepaFlash® Silica Flash Column, Eluent of 0~50% Ethyl acetate/Petroleum ether gradient @ 40 mL/min) to afford tert-butyl 3-[(4-amino-3-nitro-phenoxy)methyl]azetidine-1-carboxylate (1.4 g, 4.33 mmol, 74% yield) as a brown solid.

pyridin-2-amine (1.97 g, 4.33 mmol). The mixture was stirred at 40° C. for 2 hr. The mixture was quenched by addition of H₂O (50 mL) at 25° C., and then diluted with H₂O (50 mL) and extracted with EtOAc (50 mL×3). The combined organic layers were washed with brine (50 mL), dried over Na₂SO₄, filtered and concentrated under reduced pressure to give a residue. After that the residue was purified by flash silica gel chromatography (ISCO®; 12 g SepaFlash® Silica Flash Column, Eluent of 0~70% Ethyl acetate/

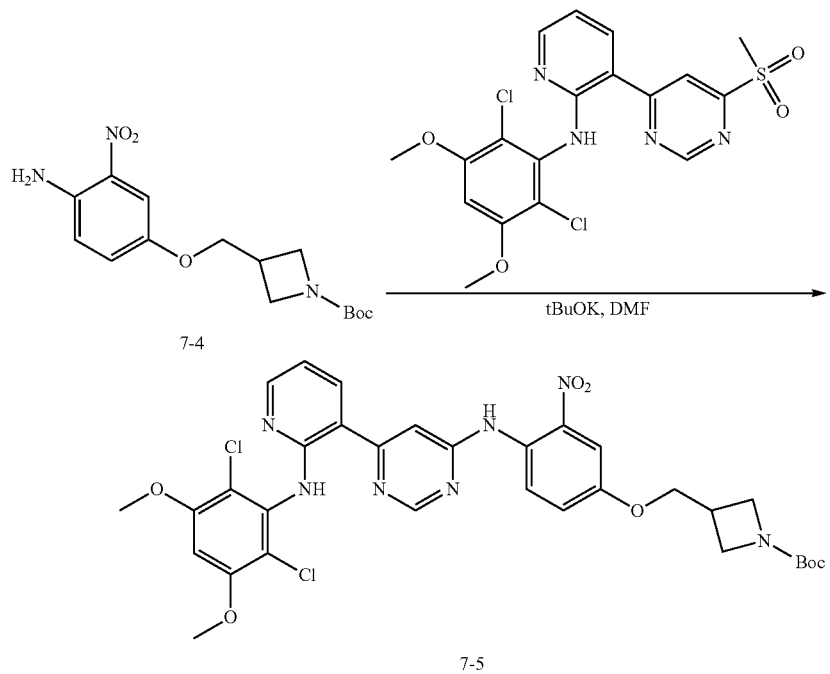

Step 3 to synthesize compound 7: To a solution of tert-butyl 3-[(4-amino-3-nitro-phenoxy)methyl]azetidine-1-carboxylate (1.4 g, 4.33 mmol) in DMF (5 mL) was added t-BuOK (583 mg, 5.20 mmol) and N-(2,6-dichloro-3,5-dimethoxy-phenyl)-3-(6-methylsulfonylpyrimidin-4-yl) Petroleum ether gradient @ 40 mL/min) to afford tert-butyl 3-[[4-[[6-[2-(2,6-dichloro-3,5-dimethoxy-anilino)-3-pyridyl]pyrimidin-4-yl]amino]-3-nitro-phenoxy]methyl]azetidine-1-carboxylate (1 g, 1.29 mmol, 30% yield, 90% purity) as a yellow solid.

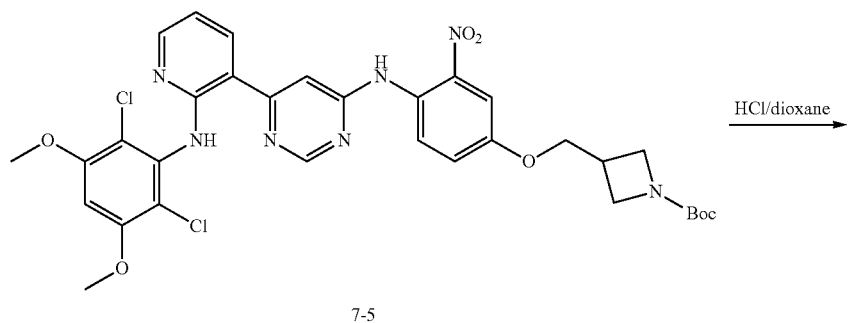

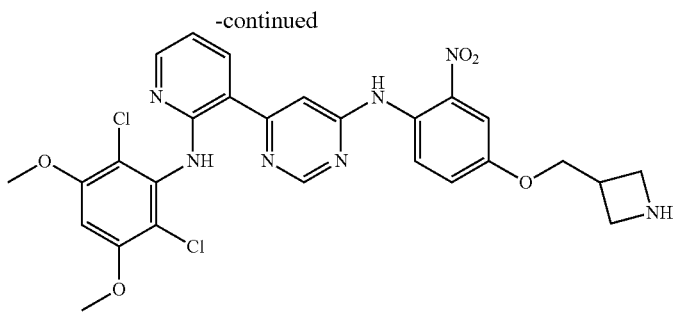

7-6

Step 4 to synthesize compound 7: A solution of tert-butyl 3-[[4-[[6-[2-(2,6-dichloro-3,5-dimethoxy-anilino)-3-pyridyl]pyrimidin-4-yl]amino]-3-nitro-phenoxy]methyl]azetidine-1-carboxylate (0.95 g, 1.36 mmol) in HCl/dioxane (4 M, 10 mL) was stirred at 25° C. for 0.5 hr. The mixture was concentrated under reduced pressure to afford N-[4-(azetidin-3-ylmethoxy)-2-nitro-phenyl]-6-[2-(2,6-dichloro-3,5-dimethoxy-anilino)-3-pyridyl]pyrimidin-4-amine (1.17 g, 1.35 mmol, 99% yield, 69% purity) as a yellow solid, which was used directly in the next step.

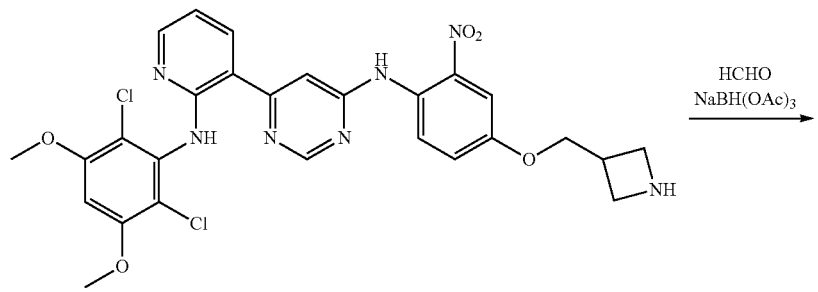

7-6

7-7

Step 5 to synthesize compound 7: To a solution of N-[4-(azetidin-3-ylmethoxy)-2-nitro-phenyl]-6-[2-(2,6-dichloro-3,5-dimethoxy-anilino)-3-pyridyl]pyrimidin-4-amine (1 g, 1.22 mmol) in MeOH (10 mL) was added aqueous HCHO (3.96 g, 48.79 mmol, 3.63 mL, 37% purity), $CH_3COOH$ (293 mg, 4.88 mmol) and $NaBH(OAc)_3$ (517 mg, 2.44 mmol). The mixture was stirred at 25° C. for 4 hr. The mixture was concentrated under reduced pressure to give a residue. After that the residue was purified by flash silica gel chromatography (ISCO®; 12 g SepaFlash® Silica Flash Column, Eluent of 0~80% Ethyl acetate/Petroleum ether gradient @ 60 mL/min) to afford 6-[2-(2,6-dichloro-3,5-dimethoxy-anilino)-3-pyridyl]-N-[4-[(1-methylazetidin-3-yl)methoxy]-2-nitro-phenyl]pyrimidin-4-amine (0.5 g, 0.735 mmol, 60% yield, 90% purity) as a yellow solid.

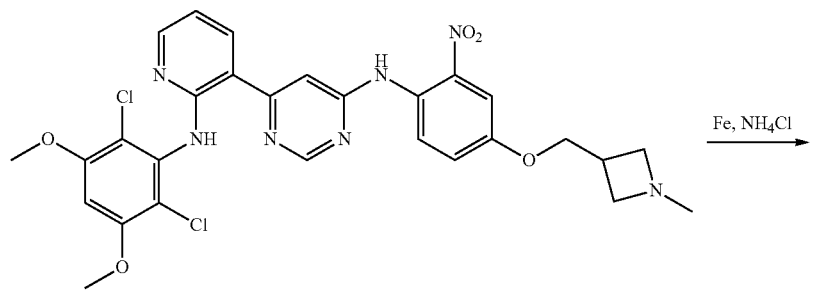

7-7

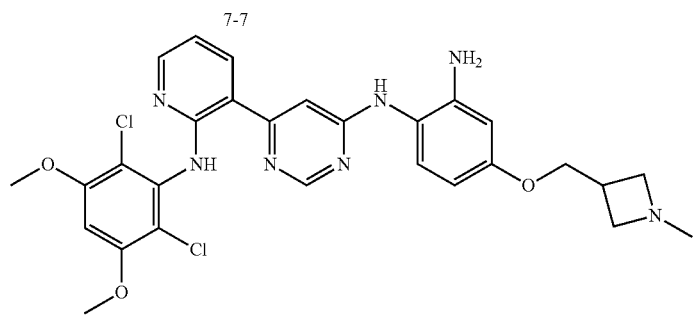

7-8

Step 6 to synthesize compound 7: To a solution of 6-[2-(2,6-dichloro-3,5-dimethoxy-anilino)-3-pyridyl]-N-[4-[(1-methylazetidin-3-yl)methoxy]-2-nitro-phenyl]pyrimidin-4-amine (0.5 g, 0.816 mmol) in THF (1 mL) and H$_2$O (1 mL) was added Fe (228 mg, 4.08 mmol) and NH$_4$C$_1$ (218 mg, 4.08 mmol). The mixture was stirred at 60° C. for 5 hr. The mixture was filtered and the filtrate was concentrated under reduced pressure to give a residue. After that the mixture was quenched by addition of H$_2$O (50 mL) at 25° C., and then diluted with H$_2$O (50 mL) and extracted with EtOAc (50 mL×3). The combined organic layers were washed with brine (50 mL), dried over Na$_2$SO$_4$, filtered and concentrated under reduced pressure to afford N$_1$-[6-[2-(2,6-dichloro-3,5-dimethoxy-anilino)-3-pyridyl]pyrimidin-4-yl]-4-[(1-methylazetidin-3-yl)methoxy]benzene-1,2-diamine (350 mg, 0.60 mmol, 74% yield) as a brown solid.

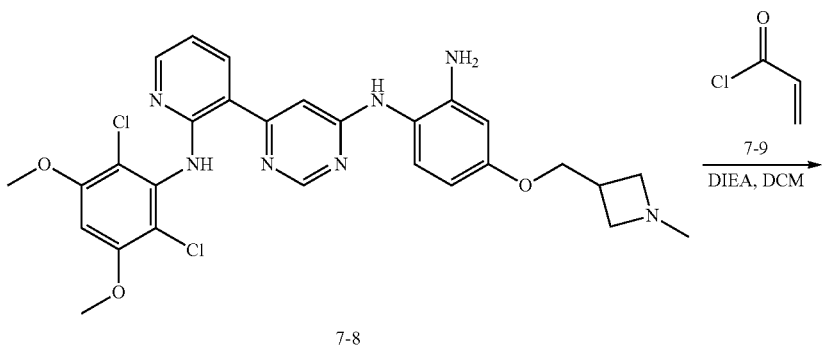

7-8

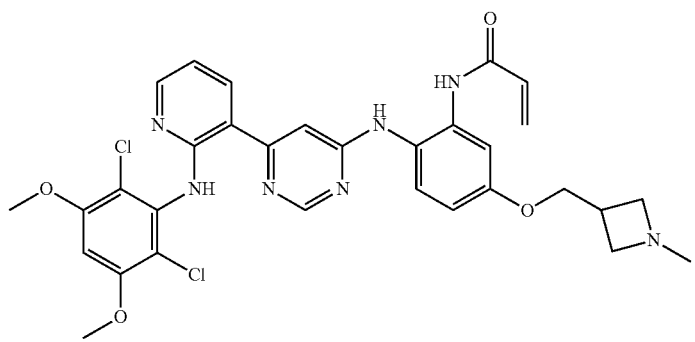

compound 7

Step 7 to synthesize compound 7: To a solution of N$_1$-[6-[2-(2,6-dichloro-3,5-dimethoxy-anilino)-3-pyridyl]pyrimidin-4-yl]-4-[(1-methylazetidin-3-yl)methoxy]benzene-1,2-diamine (0.2 g, 0.343 mmol) in DCM (5 mL) was added DIEA (133 mg, 1.03 mmol) and prop-2-enoyl chloride (34 mg, 0.378 mmol). The mixture was stirred at 0° C. for 0.5 hr. The mixture was quenched by addition of H$_2$O (50 mL) at 25° C., and then diluted with H$_2$O (50 mL) and extracted with DCM (50 mL×3). The combined organic layers were washed with brine (50 mL), dried over Na$_2$SO$_4$, filtered and concentrated under reduced pressure to give a residue. After that the residue was purified by preparative HPLC (water (0.225% FA)-ACN) to afford N-[2-[[6-[2-(2,6-dichloro-3,5-dimethoxy-anilino)-3-pyridyl]pyrimidin-4-yl]amino]-5-[(1-methylazetidin-3-yl)methoxy]phenyl]prop-2-enamide (4.8 mg, 2% yield, 92.8% purity) as a white solid.

LCMS: t$_R$=1.425 min in 10-80AB_4 min_220&254_Shimadzu.lcm, MS (ESI) m/z=636.3 [M+H]$^+$. $^1$H NMR (400 MHz, Methanol): δ=8.62 (s, 1H), 8.50 (s, 1H), 8.00-7.98 (m, 2H), 7.58-7.44 (m, 2H), 7.02-6.78 (m, 4H), 6.45-6.33 (m, 2H), 5.76 (d, J=9.6 Hz, 1H), 4.35-4.14 (m, 6H), 3.96 (s, 6H), 3.24, 2.98 (s, 3H), 2.61-2.57 (m, 1H).

Example 4

Synthesis of Compound 8

N-[2-[[6-[2-(2,6-dichloro-3,5-dimethoxy-anilino)-3-pyridyl]pyrimidin-4-yl]amino]-5-[(1-methyl-4-piperidyl)oxy]phenyl]prop-2-enamide Scheme 7. Synthesis of compound 8.

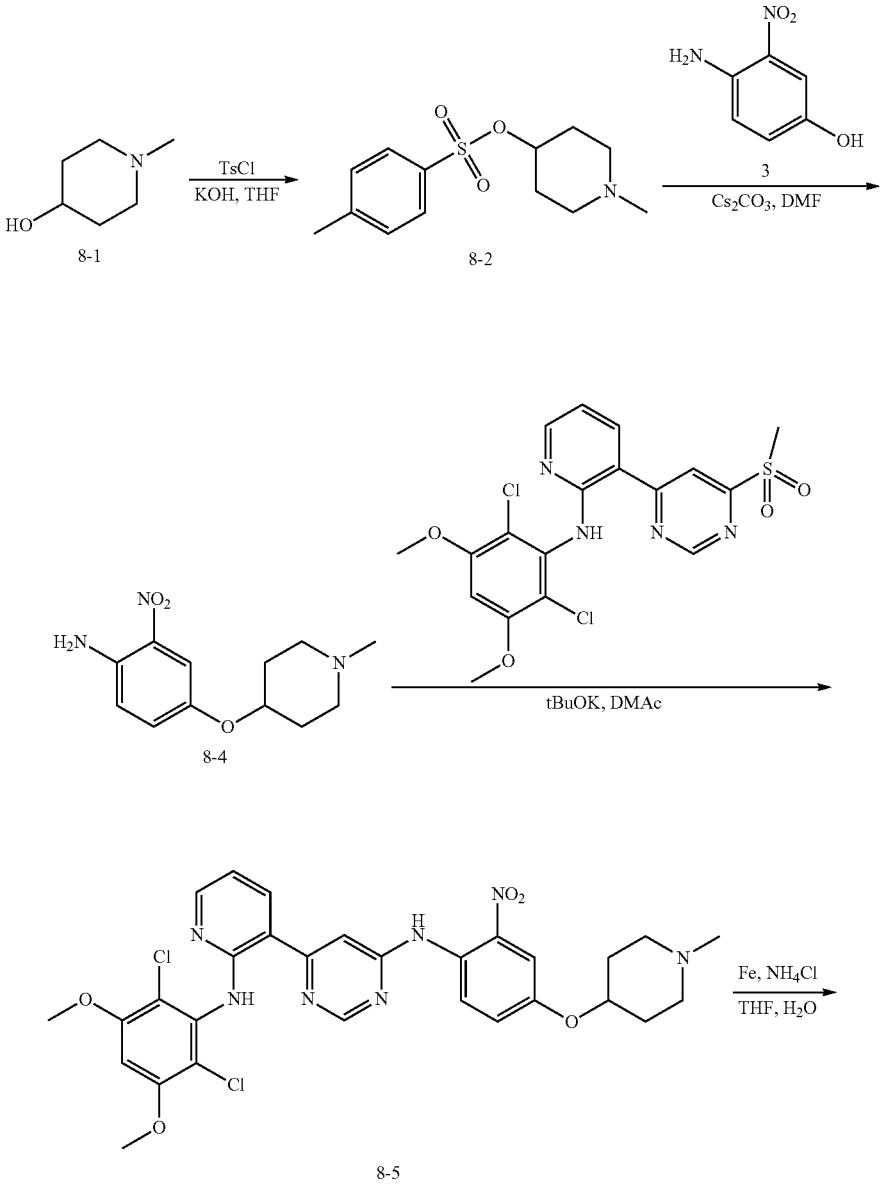

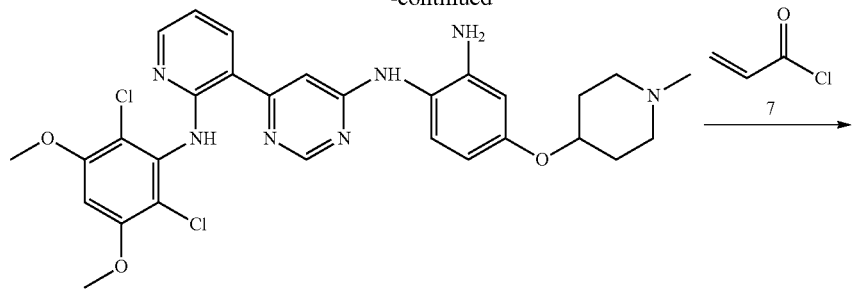

8-6

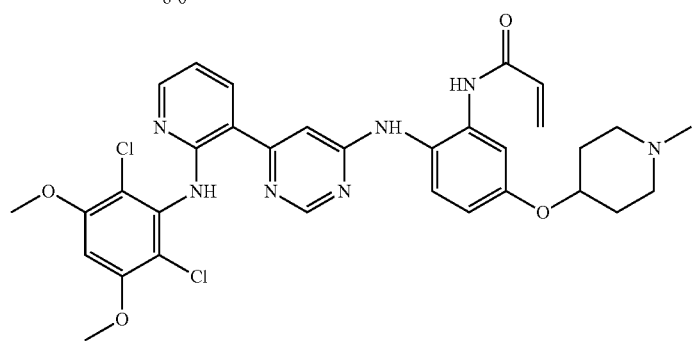

compound 8

Compound 8 was synthesized based on synthetic scheme 7. The synthetic process for each of the step is described as below.

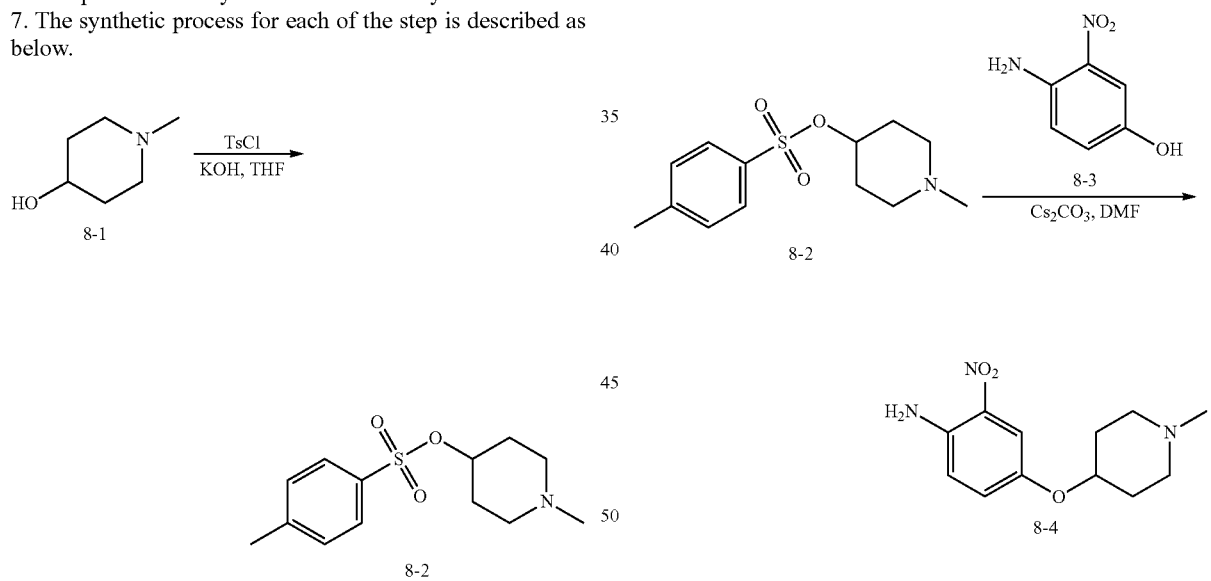

Step 1 to synthesize compound 8: To a solution of 1-methylpiperidin-4-ol (1.3 g, 11.29 mmol) in THF (10 mL) was added KOH (2.53 g, 45.15 mmol) and TsCl (3.23 g, 16.93 mmol) at 0° C. The mixture was stirred at 25° C. for 16 hr. The mixture was poured into water (30 ml) and filtered; the filter cake was collected, dried to afford (1-methyl-4-piperidyl) 4-methylbenzenesulfonate (1.8 g, 6.68 mmol, 59% yield) as a yellow oil.

Step 2 to synthesize compound 8: To a solution of 4-amino-3-nitro-phenol (400 mg, 2.60 mmol) and (1-methyl-4-piperidyl) 4-methylbenzenesulfonate (1.05 g, 3.89 mmol) in DMF (20 mL) was added $Cs_2CO_3$ (1.69 g, 5.19 mmol). The mixture was stirred at 80° C. for 8 hr. The residue was diluted with EtOAc (20 mL) and extracted with $H_2O$ (60 mL). The combined organic layers were washed with $H_2O$ (30 mL×2), dried over $Na_2SO_4$, filtered and concentrated under reduced pressure to give a residue. The residue was purified by flash silica gel chromatography (ISCO®; 12 g SepaFlash® Silica Flash Column, Eluent of 0-10% methanol/dichloromethane @ 40 mL/min) to afford 5-[(1-methyl-4-piperidyl)oxy]-2-nitro-aniline (230 mg, 0.915 mmol, 35% yield) as a brown solid.

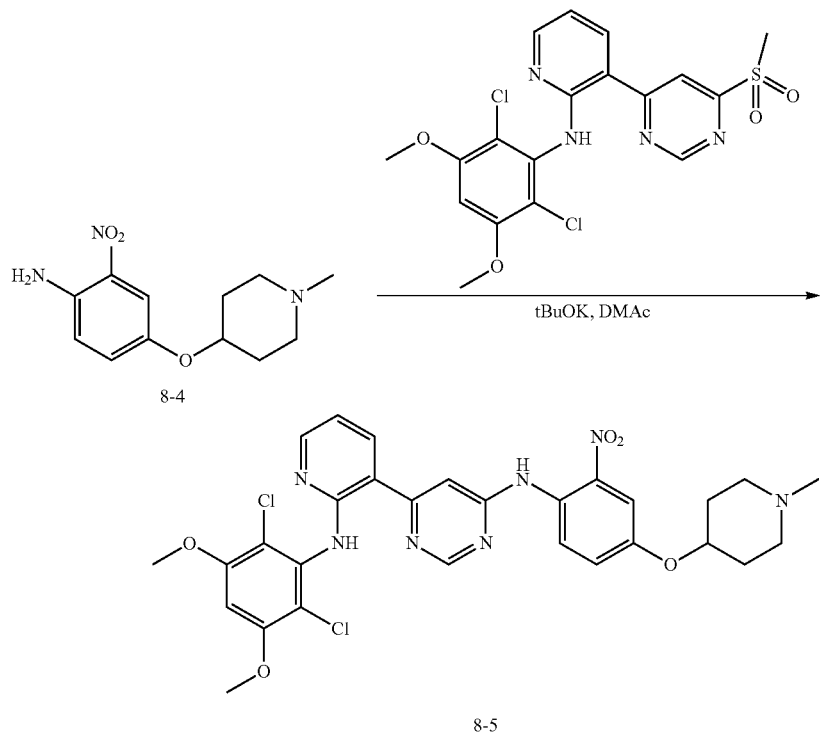

Step 3 to synthesize compound 8: To a solution of 4-[(1-methyl-4-piperidyl)oxy]-2-nitro-aniline (138 mg, 0.549 mmol) and N-(2,6-dichloro-3,5-dimethoxy-phenyl)-3-(6-methylsulfonylpyrimidin-4-yl)pyridin-2-amine (300 mg, 0.659 mmol) in DMAc (10 mL) was added tBuOK (123 mg, 1.10 mmol). The mixture was stirred at 50° C. for 2 hr. The residue was diluted with H₂O (20 mL) and extracted with EtOAc (20 mL×3). The combined organic layers were washed with H₂O (30 mL×2), dried over Na₂SO₄, filtered and concentrated under reduced pressure to give a residue. The residue was purified by flash silica gel chromatography (ISCO®; 12 g SepaFlash® Silica Flash Column, Eluent of 0~10% methanol/dichloromethane @ 40 mL/min) to afford 6-[2-(2,6-dichloro-3,5-dimethoxy-anilino)-3-pyridyl]-N-[4-[(1-methyl-4-piperidyl)oxy]-2-nitro-phenyl]pyrimidin-4-amine (200 mg, 0.16 mmol, 29% yield) as a brown solid.

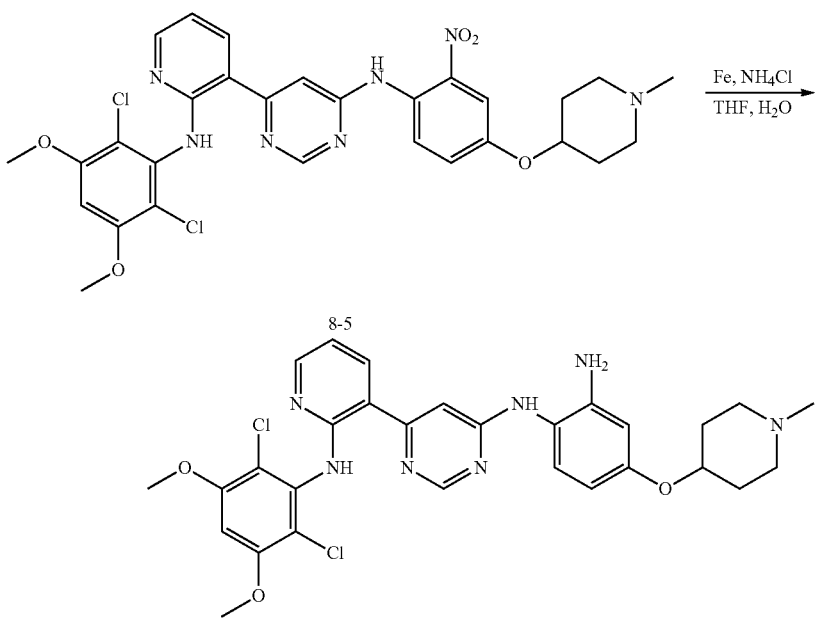

Step 4 to synthesize compound 8: To a solution of 6-[2-(2,6-dichloro-3,5-dimethoxy-anilino)-3-pyridyl]-N-[4-[(1-methyl-4-piperidyl)oxy]-2-nitro-phenyl]pyrimidin-4-amine (200 mg, 0.16 mmol) in THF (10 mL) and H$_2$O (10 mL) was added NH$_4$C$_1$ (43 mg, 0.8 mmol) and Fe (45 mg, 0.8 mmol). The mixture was stirred at 65° C. for 3 hr. The mixture was filtered with diatomite, and the filtrate was concentrated under reduced pressure to give a residue. The residue was purified by flash silica gel chromatography (ISCO®; 12 g SepaFlash® Silica Flash Column, Eluent of 0~10% Methanol/Dichloromethane @ 40 mL/min) to afford N$_1$-[6-[2-(2,6-dichloro-3,5-dimethoxy-anilino)-3-pyridyl]pyrimidin-4-yl]-4-[(1-methyl-4-piperidyl)oxy]benzene-1,2-diamine (38 mg, 0.064 mmol, 40% yield) as a yellow solid.

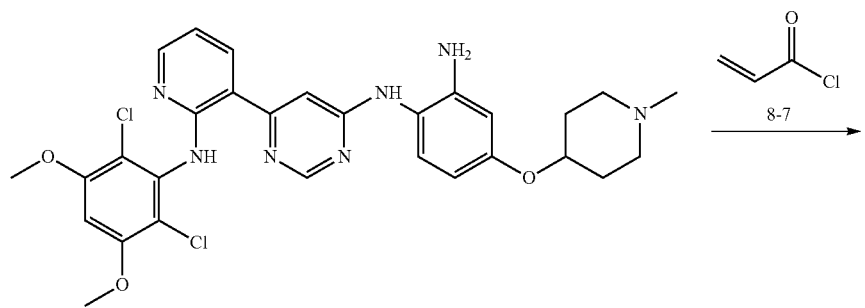

8-6

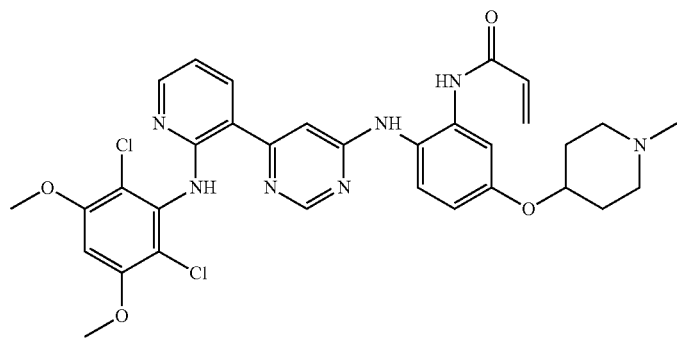

compound 8

Step 5 to synthesize compound 8: To a solution of N$_1$-[6-[2-(2,6-dichloro-3,5-dimethoxy-anilino)-3-pyridyl]pyrimidin-4-yl]-4-[(1-methyl-4-piperidyl)oxy]benzene-1,2-diamine (38 mg, 0.064 mmmol) in DCM (10 mL) and DIEA (16 mg, 0.127 mmol) was added prop-2-enoyl chloride (7 mg, 0.076 mmol). The mixture was stirred at 0° C. for 0.5 hr. The mixture was concentrated under reduced pressure to give the residue. The residue was purified by preparative HPLC (water (0.225% FA)-ACN) to afford N-[2-[[6-[2-(2,6-dichloro-3,5-dimethoxy-anilino)-3-pyridyl]pyrimidin-4-yl]amino]-5-[(1-methyl-4-piperidyl)oxy]phenyl]prop-2-enamide (11.1 mg, 0.017 mmol, 27% yield, 99.30% purity) as a yellow solid.

Example 5
Synthesis of Compound 9
N-[2-[[6-[2-(2,6-dichloro-3,5-dimethoxy-anilino)-3-pyridyl]pyrimidin-4-yl]amino]-5-(1-methylpyrrolidin-3-yl)oxy-phenyl]prop-2-enamide
Scheme 8. Synthesis of compound 9.
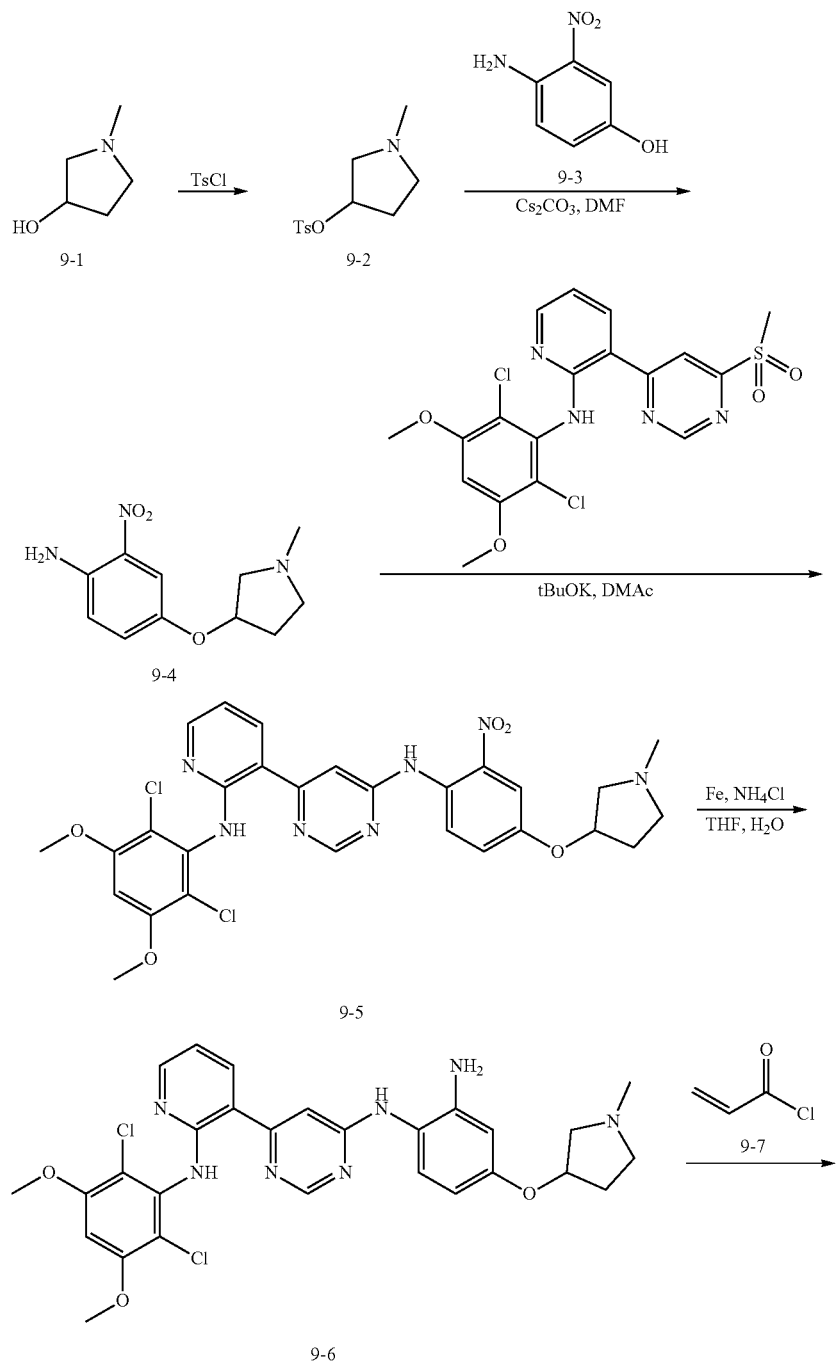

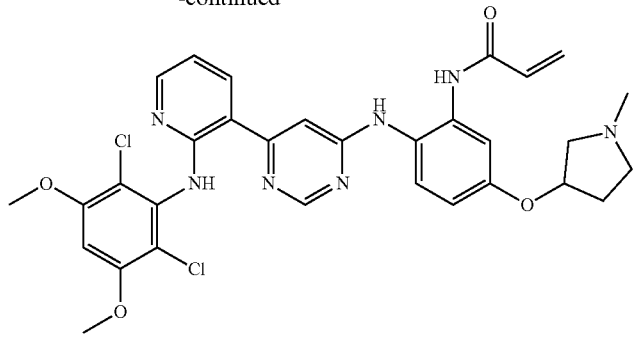

compound 9

Compound 9 was synthesized based on synthetic scheme 8. The synthetic process for each of the step is described as below.

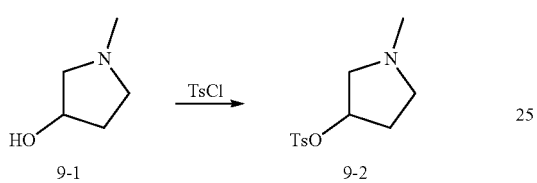

Step 1 to synthesize compound 9: To a solution of 1-methylpyrrolidin-3-ol (1.0 g, 9.89 mmol) and KOH (2.22 g, 39.55 mmol) in THF (30 mL) was added TsCl (2.83 g, 14.83 mmol) at 0° C. The mixture was stirred at 25° C. for 16 hours. The mixture was filtered and the filtrate was concentrated to afford (1-methylpyrrolidin-3-yl) 4-methylbenzenesulfonate (1.1 g, 4.31 mmol, 44% yield) as yellow oil.

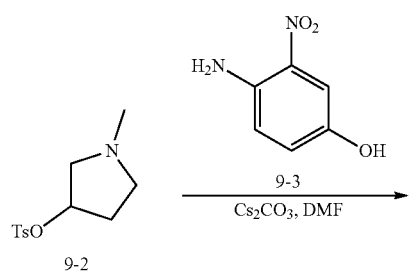

Step 2 to synthesize compound 9: To a solution of 4-amino-3-nitro-phenol (600 mg, 3.89 mmol) in DMF (20 mL) was added Cs$_2$CO$_3$ (2.54 g, 7.79 mmol). The mixture was stirred at 25° C. for 0.5 hour, then (1-methylpyrrolidin-3-yl) 4-methylbenzenesulfonate (1.09 g, 4.28 mmol) was added thereto. The mixture was stirred at 80° C. for 6 hours. The mixture was diluted with water (20 mL), extracted with EtOAc (50 mL×3), then the combined organic layers were washed with sat. aq. NaCl (20 mL×7), dried over Na$_2$SO$_4$, filtered and concentrated. The residue was purified y silica gel chromatography (DCM/MeOH=1/0 to 10/1) to afford 4-(1-methylpyrrolidin-3-yl)oxy-2-nitro-aniline (600 mg, 2.53 mmol, 65% yield) as a red solid.

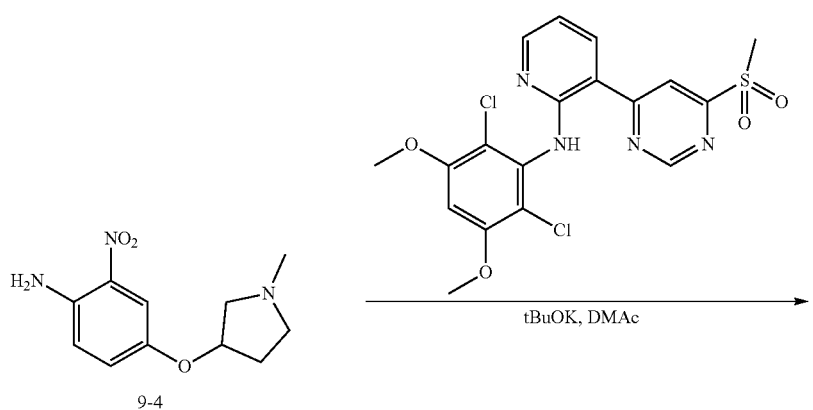

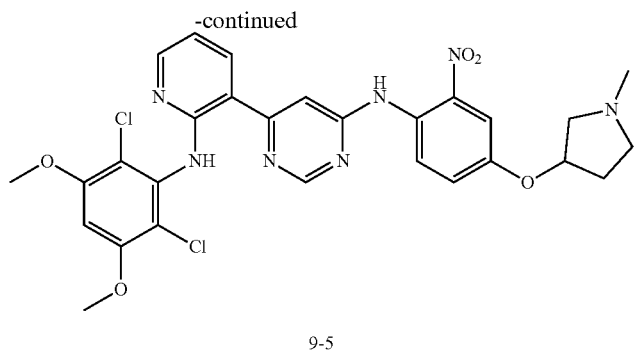

9-5

Step 3 to synthesize compound 9: To a solution of 4-(1-methylpyrrolidin-3-yl)oxy-2-nitro-aniline (200 mg, 0.843 mmol), N-(2,6-dichloro-3,5-dimethoxy-phenyl)-3-(6-methylsulfonylpyrimidin-4-yl)pyridin-2-amine (422 mg, 0.927 mmol) in DMAC (10 mL) was added t-BuOK (286 mg, 2.55 mmol). The mixture was stirred at 40° C. for 2 hours. The mixture was diluted with water (20 mL), extracted with EtOAc (50 mL×3), then the combined organic layers were dried over $Na_2SO_4$, filtered and concentrated to afford 6-[2-(2,6-dichloro-3,5-dimethoxy-anilino)-3-pyridyl]-N-[4-(1-methylpyrrolidin-3-yl)oxy-2-nitro-phenyl]pyrimidin-4-amine (500 mg, crude) as yellow solid.

Step 4 to synthesize compound 9: To a solution of 6-[2-(2,6-dichloro-3,5-dimethoxy-anilino)-3-pyridyl]-N-[4-(1-methylpyrrolidin-3-yl)oxy-2-nitro-phenyl]pyrimidin-4-amine (300 mg, 0.49 mmol) in THF (10 mL) and $H_2O$ (10 mL) was added Fe (137 mg, 2.45 mmol) and $NH_4Cl$ (131 mg, 2.45 mmol). The mixture was stirred at 65° C. for 4 hours. The mixture was filtered and the filtrate was extracted with EtOAc (30 mL×3), then the combined organic layers were dried over $Na_2SO_4$, filtered and concentrated to afford $N_1$-[6-[2-(2,6-dichloro-3,5-dimethoxy-anilino)-3-pyridyl]pyrimidin-4-yl]-4-(1-methylpyrrolidin-3-yl)oxy-benzene-1,2-diamine (150 mg, 0.258 mmol, 52% yield) as a yellow solid.

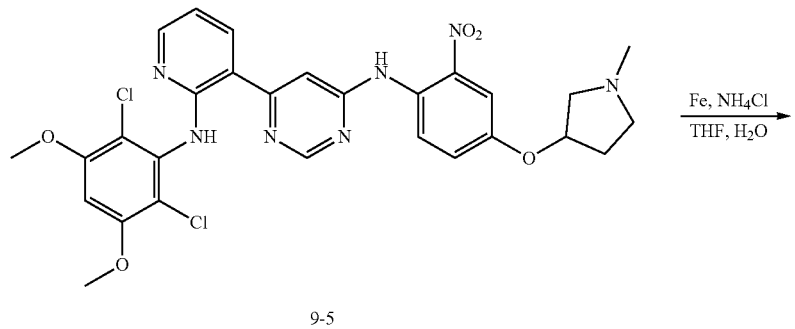

9-5

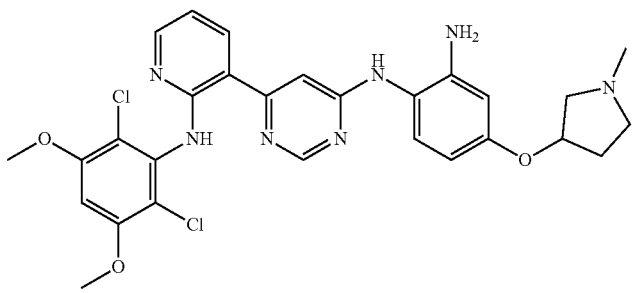

9-6

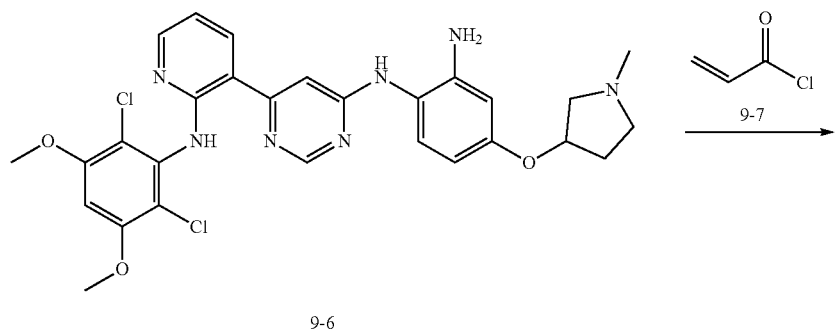

9-6

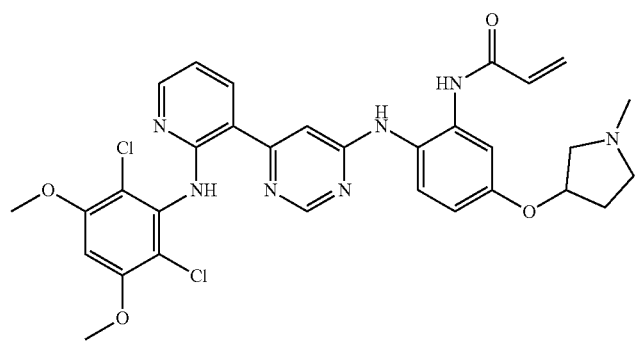

compound 9

Step 5 to synthesize compound 9: To a solution of $N_1$-[6-[2-(2,6-dichloro-3,5-dimethoxy-anilino)-3-pyridyl]pyrimidin-4-yl]-4-(1-methylpyrrolidin-3-yl)oxy-benzene-1,2-diamine (120 mg, 0.206 mmol) in DCM (10 mL) was added prop-2-enoyl chloride (19 mg, 0.206 mmol) and DIEA (27 mg, 0.206 mmol). The mixture was stirred at 25° C. for 1 hour. The mixture was diluted with water (5 mL), extracted with DCM (10 mL×3), then the combined organic layers were dried over $Na_2SO_4$, filtered and concentrated. The residue was purified by preparative HPLC (water (0.225% FA)-ACN) to afford N-[2-[[6-[2-(2,6-dichloro-3,5-dimethoxy-anilino)-3-pyridyl]pyrimidin-4-yl]amino]-5-(1-methylpyrrolidin-3-yl)oxy-phenyl]prop-2-enamide (50 mg, 0.0778 mmol, 38% yield, 99% purity) as yellow solid. LCMS: $t_R$=1.129 min in 10-80AB_4 min_220&254_Shimadzu.lcm, MS (ESI) m/z=636.2 $[M+H]^+$. $^1$H NMR (400 MHz, DMSO-$d_6$): δ=10.88 (s, 1H), 10.15 (s, 1H), 9.65 (s, 1H), 9.10 (s, 1H), 8.64 (s, 1H), 8.06 (d, J=4.4 Hz, 1H), 7.96 (d, J=7.6 Hz, 1H), 7.54 (s, 1H), 7.46 (d, J=8.4 Hz, 1H), 7.01-6.98 (m, 1H), 6.88-6.83 (m, 3H), 6.52-6.49 (m, 1H), 6.26-6.21 (m, 1H), 5.74-5.71 (m, 1H), 5.17-5.12 (m, 1H), 3.93 (s, 6H), 3.81-3.61 (m, 1H), 3.41-2.89 (m, 6H), 2.61-2.54 (m, 1H), 2.30-2.10 (m, 1H).

Example 6
Synthesis of Compound 10
N-[2-[[6-[2-(2,6-dichloro-3,5-dimethoxy-anilino)-3-pyridyl]pyrimidin-4-yl]amino]-5-tetrahydrofuran-3-yloxy-phenyl]prop-2-enamide
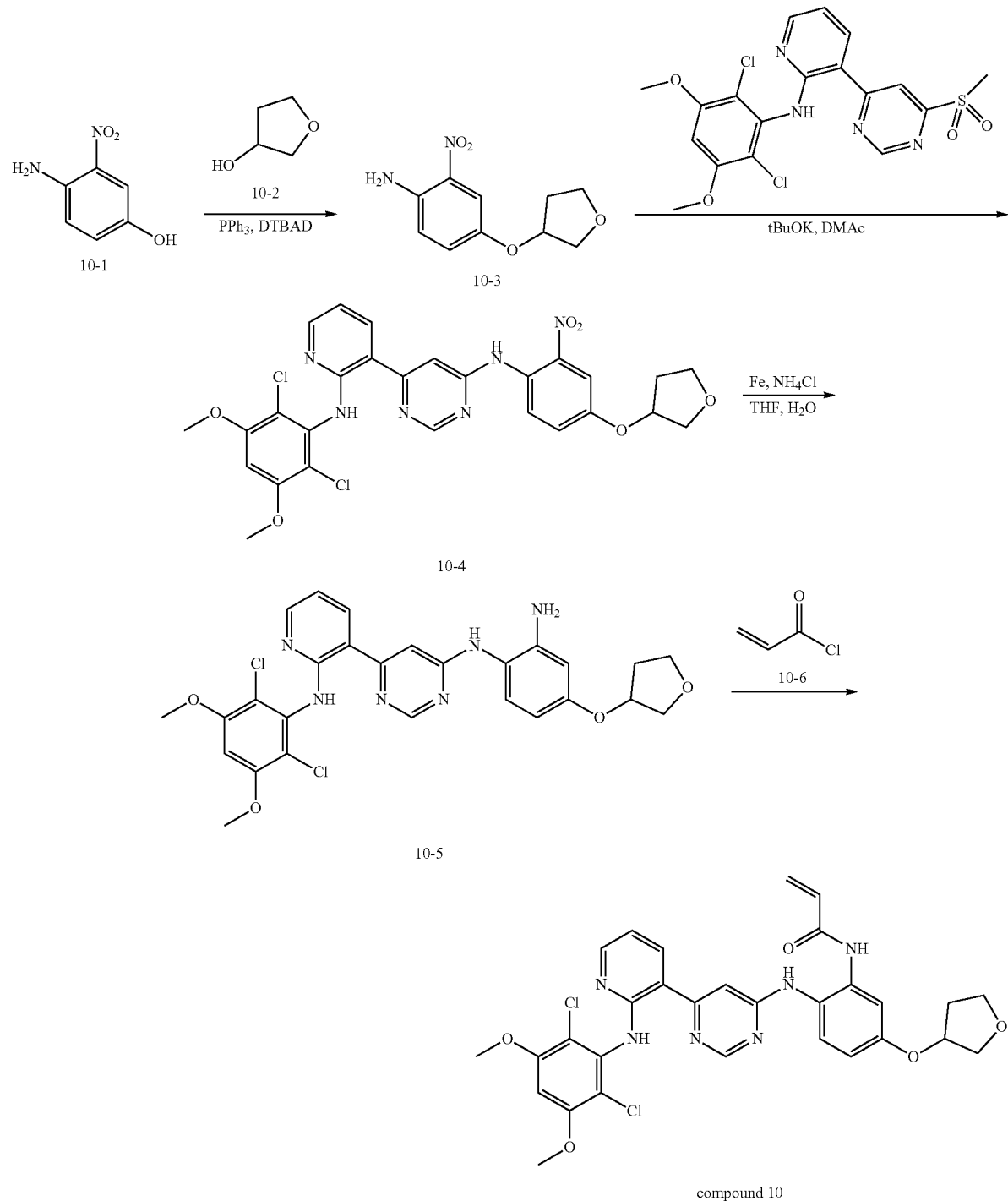
Scheme 9. Synthesis of compound 10.

Compound 10 was synthesized based on synthetic scheme 9. The synthetic process for each of the step is described as below.

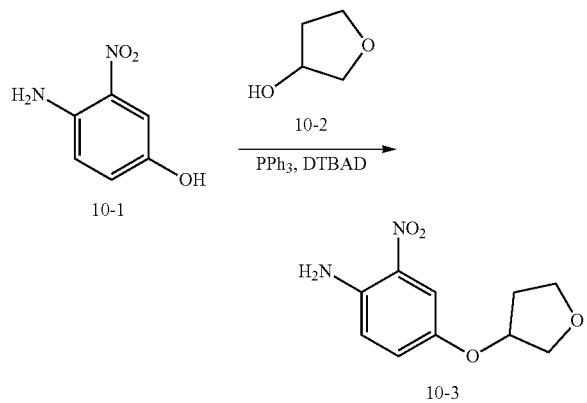

Step 1 to synthesize compound 10: To a solution of 4-amino-3-nitro-phenol (4 g, 25.95 mmol), tetrahydrofuran-3-ol (2.29 g, 25.95 mmol) and PPh$_3$ (8.17 g, 31.14 mmol) in THF (25 mL) was added a solution of DTBAD (8.96 g, 38.93 mmol) in THF (25 mL) dropwise at 0° C. under N$_2$. The mixture was stirred at 0° C. for 0.5 h then warmed to 25° C. for 15.5 h. The mixture was concentrated. The residue was purified by column chromatography (SiO$_2$, Petroleum ether/Ethyl acetate=5/1 to 3/1) and the residue was recrystallized from CH$_3$CN to afford 2-nitro-4-tetrahydrofuran-3-yloxy-aniline (1.1 g, 4.78 mmol, 18% yield, 97.5% purity) as a red solid. LCMS: t$_R$=0.824 min in 0-30AB_4 min_220&254_Shimadzu.lcm, MS (ESI) m/z=225.2 [M+H]$^+$. $^1$H NMR (400 MHz, CDCl$_3$): δ=7.44 (s, 1H), 7.00-6.95 (m, 1H), 6.72-6.66 (m, 1H), 5.84 (s, 2H), 4.84-4.80 (m, 1H), 3.93-3.83 (m, 4H), 2.19-2.03 (m, 2H).

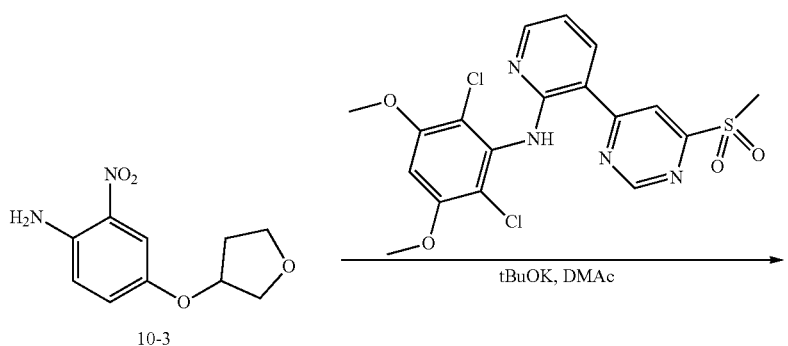

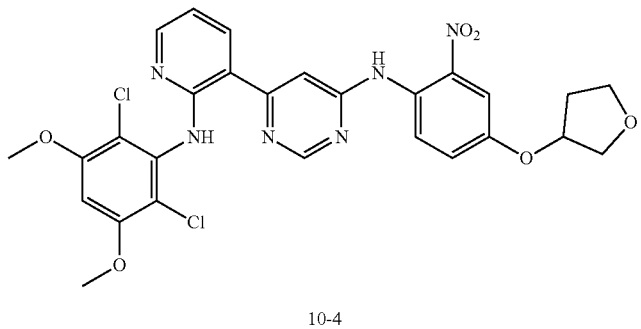

Step 2 to synthesize compound 10: To a solution of N-(2,6-dichloro-3,5-dimethoxy-phenyl)-3-(6-methylsulfonylpyrimidin-4-yl)pyridin-2-amine (300 mg, 0.66 mmol) and 2-nitro-4-tetrahydrofuran-3-yloxy-aniline (296 mg, 1.32 mmol) in DMAc (30 mL) was added tBuOK (148 mg, 1.32 mmol). The mixture was stirred at 40° C. for 2 hr. The mixture was poured into water (60 mL) and filtered, the filter cake was collected in vacuo to afford 6-[2-(2,6-dichloro-3,5-dimethoxy-anilino)-3-pyridyl]-N-(2-nitro-4-tetrahydrofuran-3-yloxy-phenyl)pyrimidin-4-amine (240 mg, 0.40 mmol, 61% yield) as a yellow solid.

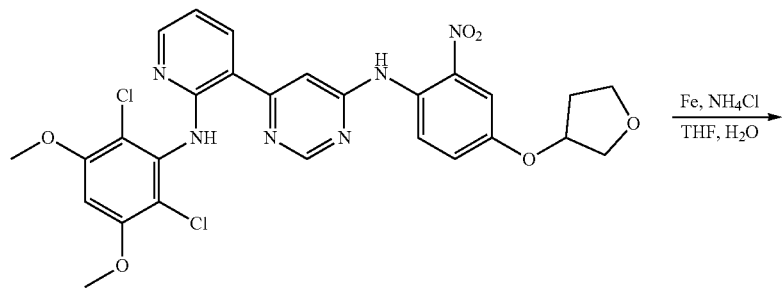

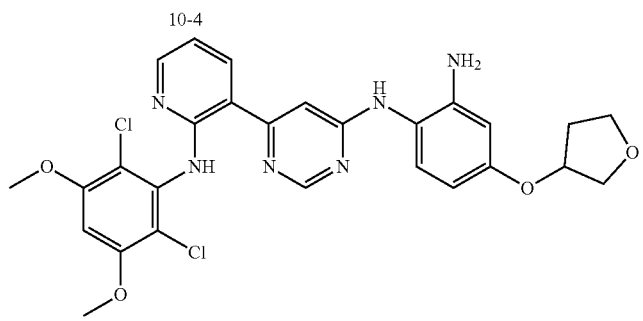

Step 3 to synthesize compound 10: To a solution of 6-[2-(2,6-dichloro-3,5-dimethoxy-anilino)-3-pyridyl]-N-(2-nitro-4-tetrahydrofuran-3-yloxy-phenyl)pyrimidin-4-amine (240 mg, 0.40 mmol) in THF (10 mL) and $H_2O$ (10 mL) was added Fe (112 mg, 2.00 mmol) and $NH_4Cl$ (107 mg, 2.00 mmol). The mixture was stirred at 65° C. for 3 hr. The mixture was filtered with diatomite, and the filtrate was concentrated under reduced pressure to afford $N_1$-[6-[2-(2,6-dichloro-3,5-dimethoxy-anilino)-3-pyridyl]pyrimidin-4-yl]-4-tetrahydrofuran-3-yloxy-benzene-1,2-diamine (300 mg, 0.368 mmol, 92% yield, 90% purity) as a red solid. LCMS: $t_R$=0.922 min in 0-60AB_2 min_220&254_Shimadzu.lcm, MS (ESI) m/z=569.1 $[M+H]^+$.

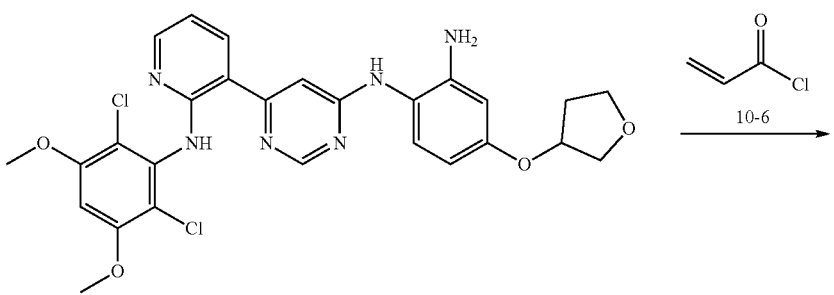

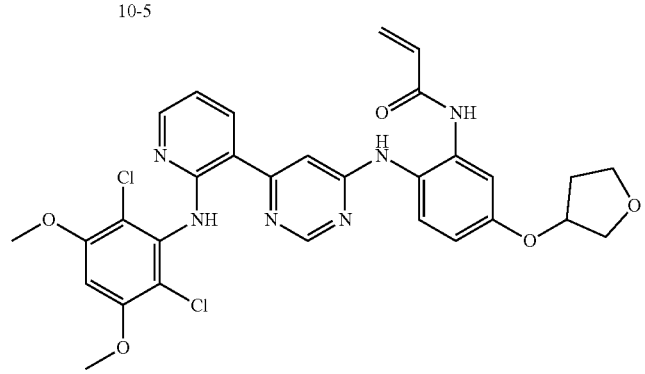

compound 10

Step 4 to synthesize compound 10: To a solution of N$_1$-[6-[2-(2,6-dichloro-3,5-dimethoxy-anilino)-3-pyridyl]pyrimidin-4-yl]-4-tetrahydrofuran-3-yloxy-benzene-1,2-diamine (220 mg, 0.386 mmol) in DCM (10 mL) and DIEA (100 mg, 0.772 mmol) and prop-2-enoyl chloride (31 mg, 0.348 mmol) at 0° C. The mixture was stirred at 0° C. for 0.5 hr. The mixture was concentrated under reduced pressure. The residue was purified by preparative HPLC (water (0.225% FA)-ACN) to afford N-[2-[[6-[2-(2,6-dichloro-3,5-dimethoxy-anilino)-3-pyridyl]pyrimidin-4-yl]amino]-5-tetrahydrofuran-3-yloxy-phenyl]prop-2-enamide (100 mg, 0.159 mmol, 41% yield, 99.2% purity) as a yellow solid. LCMS: t$_R$=2.148 min in 0-60AB_4 min_220&254_Shimadzu.lcm, MS (ESI) m/z=623.1 [M+H]$^+$. $^1$H NMR (400 MHz, DMSO-d$_6$): δ=9.66 (s, 1H), 8.67 (s, 1H), 8.07-7.93 (m, 2H), 7.44-7.39 (m, 2H), 6.92 (s, 1H), 6.88-6.77 (m, 3H), 6.53-6.49 (m, 1H), 6.26-6.21 (m, 1H), 5.71 (dd, J=10.0 and 2.0 Hz, 1H), 5.00 (t, J=5.6 Hz, 1H), 3.94 (s, 6H), 3.89-3.76 (m, 4H), 2.26-2.21 (m, 1H), 2.04-1.98 (m, 1H).

Example 7

Synthesis of Compound 11

N-[2-[[6-[2-(2,6-dichloro-3,5-dimethoxy-anilino)-3-pyridyl]pyrimidin-4-yl]amino]-5-(oxetan-3-yloxy)phenyl]prop-2-enamide Scheme 10. Synthesis of compound 11.

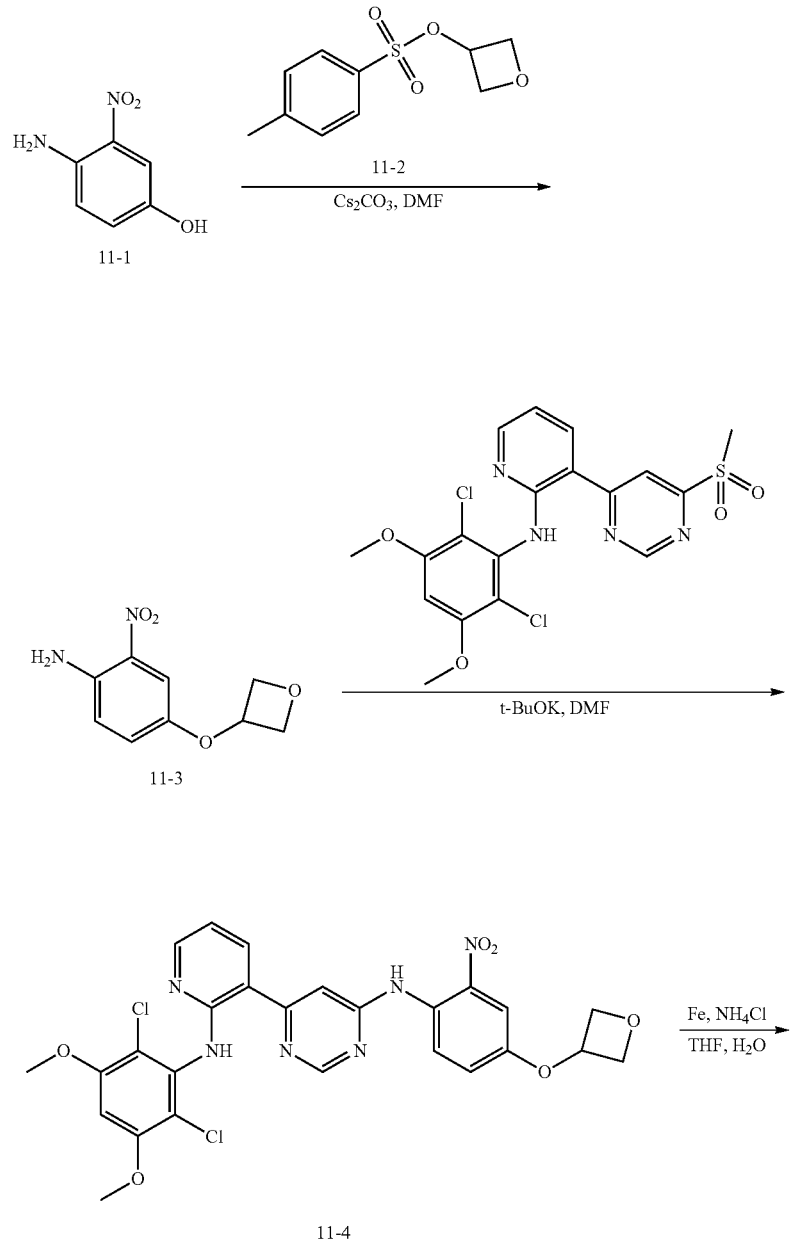

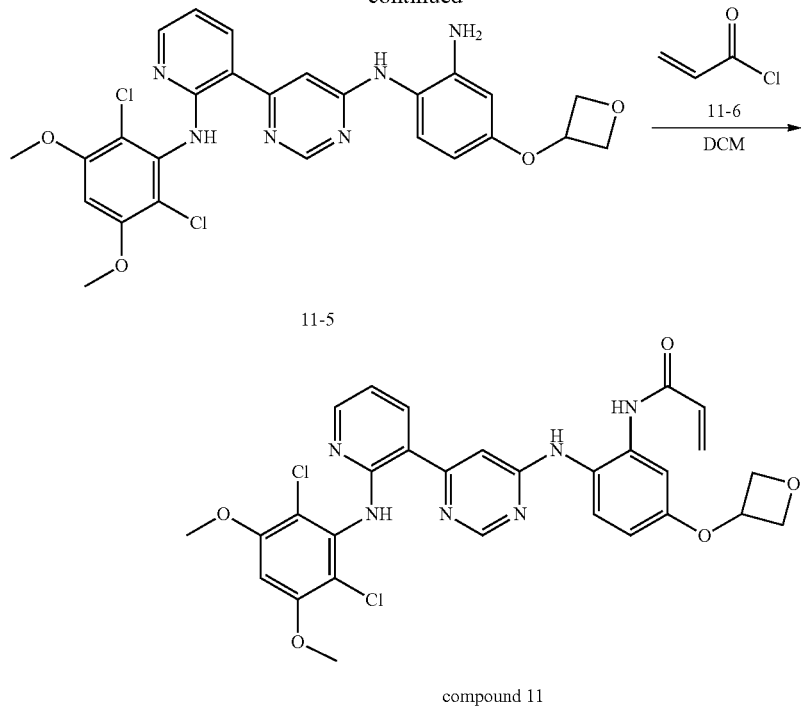

11-5 compound 11

Compound 11 was synthesized based on synthetic scheme 10. The synthetic process for each of the step is described as below.

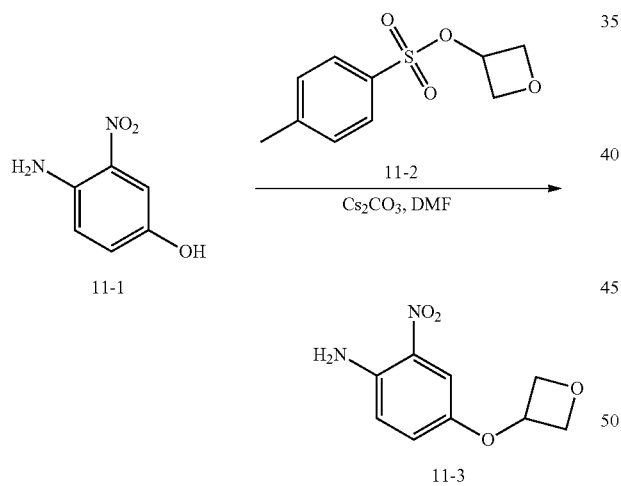

Step 1 to synthesize compound 11: To a solution of 4-amino-3-nitro-phenol (200 mg, 1.30 mmol) in DMF (5 mL) was added $Cs_2CO_3$ (846 mg, 2.60 mmol). The mixture was stirred at 25° C. for 0.5 hour, then oxetan-3-yl 4-methylbenzenesulfonate (444 mg, 1.95 mmol) was added. The mixture was heated to 80° C. for 6 hours. The mixture was diluted with water (10 mL), extracted with EtOAc (20 mL×3), then the combined organic layers were dried over $Na_2SO_4$, filtered and concentrated. The residue was purified by silica gel chromatography (PE/EtOAc=1/0 to 3/1) to afford 2-nitro-4-(oxetan-3-yloxy)aniline (100 mg, 0.476 mmol, 37% yield) as red solid. $^1H$ NMR (400 MHz, DMSO-$d_6$): δ=7.30 (s, 2H), 7.16-7.09 (m, 2H), 7.20 (d, J=9.2 Hz, 1H), 5.27-5.22 (m, 1H), 4.91-4.87 (m, 2H), 4.54-4.51 (m, 2H).

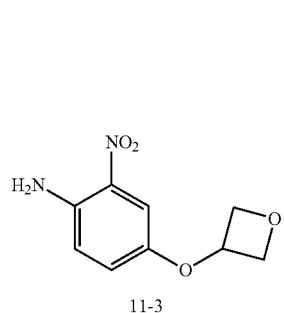
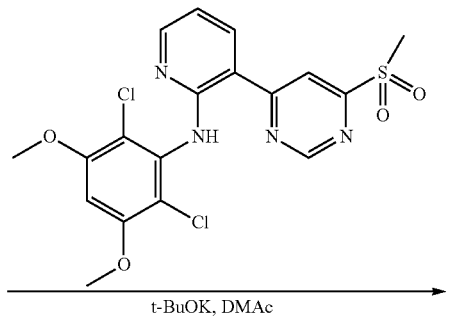

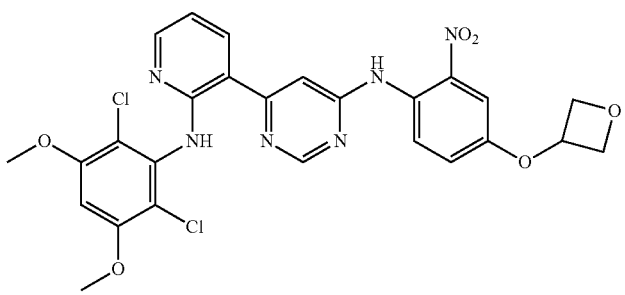

Step 2 to synthesize compound 11: To a solution of N-(2,6-dichloro-3,5-dimethoxy-phenyl)-3-(6-methylsulfonylpyrimidin-4-yl)pyridin-2-amine (300 mg, 0.659 mmol), 2-nitro-4-(oxetan-3-yloxy)aniline (138 mg, 0.659 mmol) in DMAc (10 mL) was added t-BuOK (223 mg, 1.99 mmol) at 0° C. The mixture was then heated to 40° C. a for 2 hours. The mixture was diluted with water (10 mL), extracted with EtOAc (20 mL×3). Then the combined organic layers were washed with sat. aq. NaCl (10 mL×7), dried over $Na_2SO_4$, filtered and concentrated. The residue was triturated with $CH_3CN$ (5 mL) at 25° C. for 5 min. The precipitation was filtered, dried to afford 6-[2-(2,6-dichloro-3,5-dimethoxy-anilino)-3-pyridyl]-N-[2-nitro-4-(oxetan-3-yloxy)phenyl]pyrimidin-4-amine (300 mg, 0.512 mmol, 78% yield) as a yellow solid.

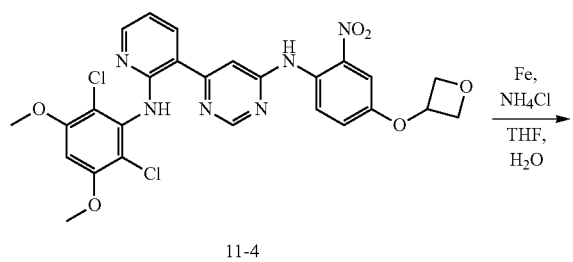

Step 3 to synthesize compound 11: To a solution of 6-[2-(2,6-dichloro-3,5-dimethoxy-anilino)-3-pyridyl]-N-[2-nitro-4-(oxetan-3-yloxy)phenyl]pyrimidin-4-amine (200 mg, 0.34 mmol) in THF (10 mL) and $H_2O$ (10 mL) was added Fe (95 mg, 1.71 mmol) and $NH_4C_1$ (91 mg, 1.71 mmol). The mixture was stirred at 65° C. for 4 hours. The mixture was cooled to room temperature, filtered, and the filtrated was concentrated to afford $N_1$-[6-[2-(2,6-dichloro-3,5-dimethoxy-anilino)-3-pyridyl]pyrimidin-4-yl]-4-(oxetan-3-yloxy)benzene-1,2-diamine (180 mg, crude) as yellow solid.

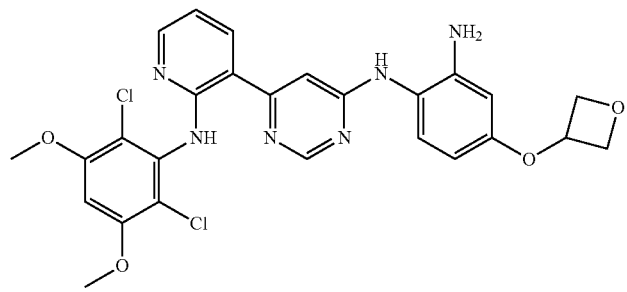
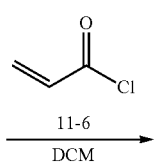

11-5

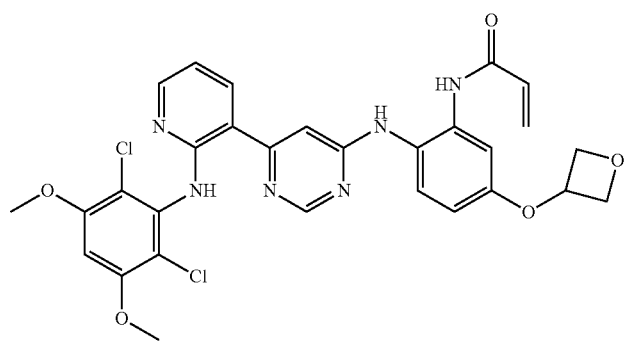

compound 11

Step 4 to synthesize compound 11: To a solution of N₁-[6-[2-(2,6-dichloro-3,5-dimethoxy-anilino)-3-pyridyl]pyrimidin-4-yl]-4-(oxetan-3-yloxy)benzene-1,2-diamine (150 mg, 0.27 mmol) in DCM (15 mL) was added prop-2-enoyl chloride (19 mg, 0.216 mmol) at 0° C. The mixture was stirred at 25° C. for 0.5 hour. The mixture was quenched by water (10 mL), then extracted with DCM (50 mL×3), dried over Na₂SO₄, filtered and concentrated. The residue was purified preparative HPLC (Colum: Xtimate C18 100*30 mm*3 um, water (0.04% NH₃·H₂O+10 mM NH₄HCO₃)-ACN; B % from 63 to 83; Gradient Time: 30 min; Flow rate: 25 mL/min) then further purified by chiral SFC (Instrument: CAS-QD-ANA-SFC-SD (Agilent 1260 with DAD detector), Column: Chiralcel OJ-3 100×4.6 mm I.D., 3 um. Mobile phase: A: CO₂ B: ethanol (0.05% DEA), Gradient: from 5% to 40% of B in 4.5 min and hold 40% for 2.5 min, then 5% of B for 1 min Flow rate: 2.8 mL/min, Column temperature: 40° C.) to afford N-[2-[[6-[2-(2,6-dichloro-3,5-dimethoxy-anilino)-3-pyridyl]pyrimidin-4-yl]amino]-5-(oxetan-3-yloxy)phenyl]prop-2-enamide (30 mg, 0.049 mmol, 18% yield, 100% purity) as yellow solid. LCMS: $t_R$=2.023 min in:10-80CD_4 min_Pos_220&254_Shimadzu.lcm, MS (ESI) m/z=609.2 [M+H]⁺. ¹H NMR (400 MHz, DMSO-d₆): δ=10.93 (s, 1H), 9.66 (s, 1H), 8.98 (s, 1H), 8.61 (s, 1H), 8.07-7.96 (m, 2H), 7.42-7.34 (m, 2H), 6.92 (s, 1H), 6.86-6.84 (m, 2H), 6.66-6.55 (m, 2H), 6.26-6.21 (m, 1H), 5.74-5.71 (m, 1H), 5.29-5.26 (m, 1H), 4.94-4.91 (m, 2H), 4.59-4.56 (m, 2H), 3.37 (s, 6H).

Example 8

Synthesis of Compound 12

N-[2-[[6-[2-(2,6-dichloro-3,5-dimethoxy-anilino)-3-pyridyl]pyrimidin-4-yl]amino]-5-(2-pyrrolidin-1-ylethoxy)phenyl]prop-2-enamide Scheme 11. Synthesis of compound 12.

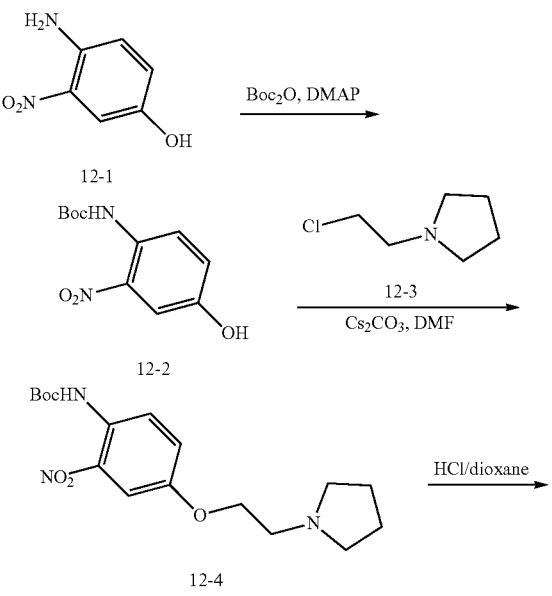

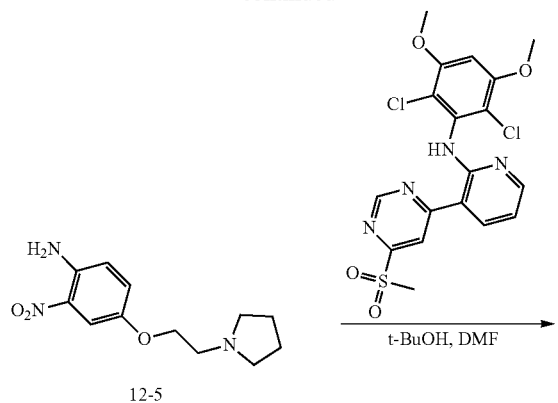
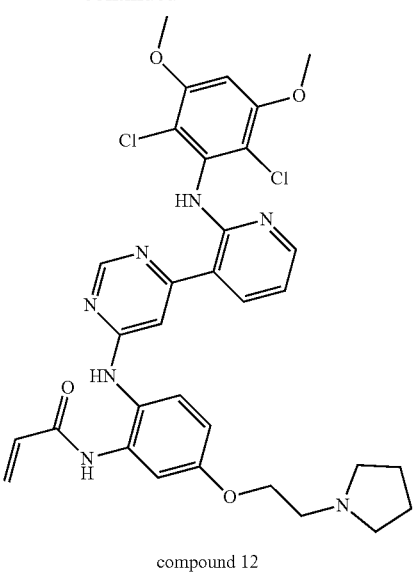
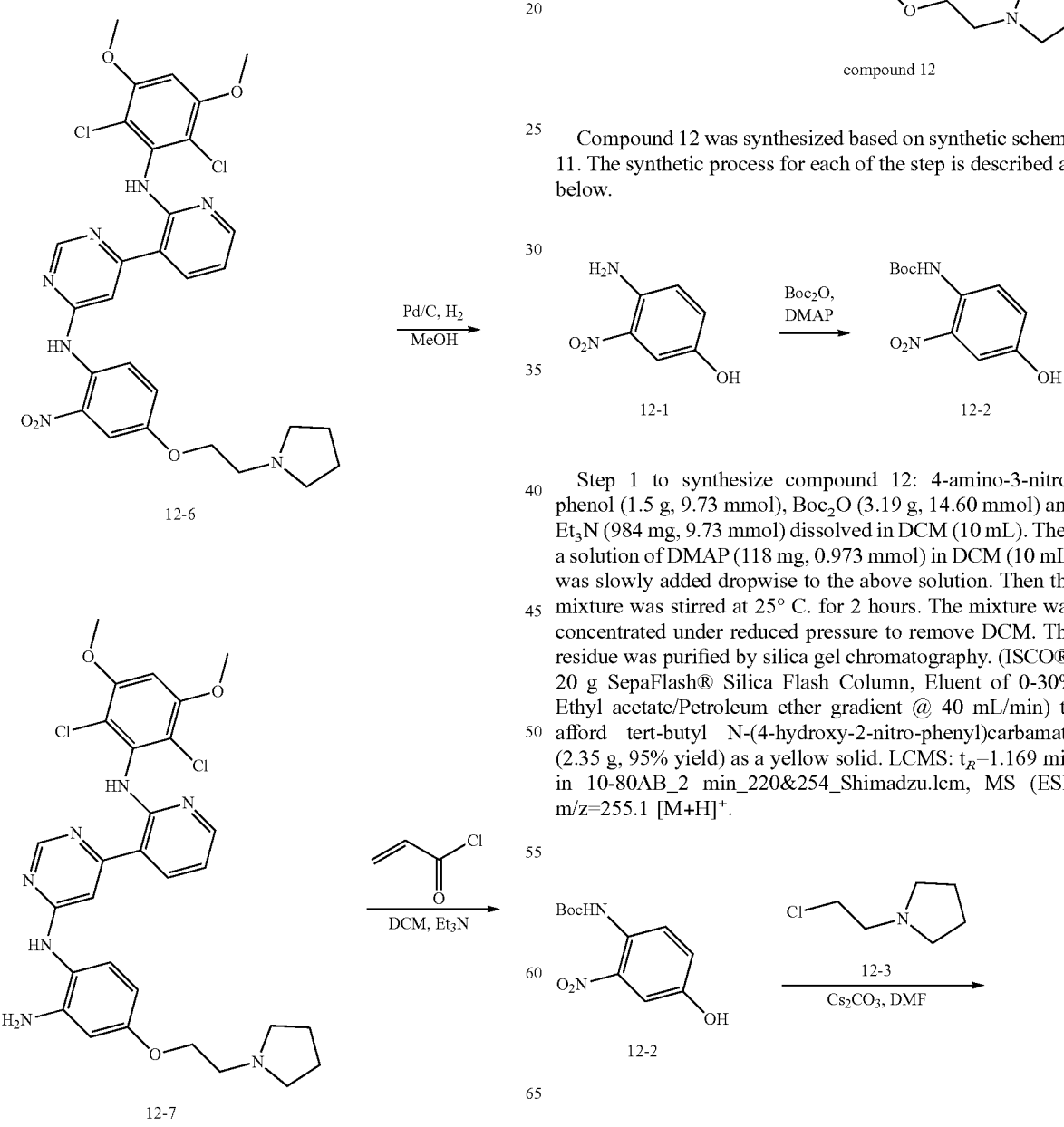

Compound 12 was synthesized based on synthetic scheme 11. The synthetic process for each of the step is described as below.

Step 1 to synthesize compound 12: 4-amino-3-nitrophenol (1.5 g, 9.73 mmol), Boc$_2$O (3.19 g, 14.60 mmol) and Et$_3$N (984 mg, 9.73 mmol) dissolved in DCM (10 mL). Then a solution of DMAP (118 mg, 0.973 mmol) in DCM (10 mL) was slowly added dropwise to the above solution. Then the mixture was stirred at 25° C. for 2 hours. The mixture was concentrated under reduced pressure to remove DCM. The residue was purified by silica gel chromatography. (ISCO®; 20 g SepaFlash® Silica Flash Column, Eluent of 0-30% Ethyl acetate/Petroleum ether gradient @ 40 mL/min) to afford tert-butyl N-(4-hydroxy-2-nitro-phenyl)carbamate (2.35 g, 95% yield) as a yellow solid. LCMS: t$_R$=1.169 min in 10-80AB_2 min_220&254_Shimadzu.lcm, MS (ESI) m/z=255.1 [M+H]$^+$.

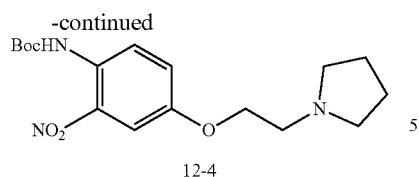
12-4

Step 2 to synthesize compound 12: A solution of 1-(2-chloroethyl)pyrrolidine (2.25 g, 13.22 mmol, HCl salt), tert-butyl N-(4-hydroxy-2-nitro-phenyl)carbamate (2.8 g, 11.01 mmol), Cs$_2$CO$_3$ (7.18 g, 22.03 mmol,) in DMF (100 mL) was stirred at 50° C. for 8 hours. The mixture was extracted with EtOAc (200 mL×5). The combined organic layers were washed with H$_2$O (50 mL×6), dried over Na$_2$SO$_4$, filtered and concentrated under reduced pressure to give a residue. The residue was purified by flash silica gel chromatography (ISCO®; 20 g SepaFlash® Silica Flash Column, Eluent of 0-35% Ethyl acetate/Petroleum ether gradient @ 40 mL/min) to afford tert-butyl N-[2-nitro-4-(2-pyrrolidin-1-ylethoxy)phenyl]carbamate (1.2 g, 31% yield) as a black solid. LCMS: $t_R$=0.980 min in 10-80 AB_2 min_220&254_Shimadzu.lcm, MS (ESI) m/z=352.1 [M+H]$^+$.

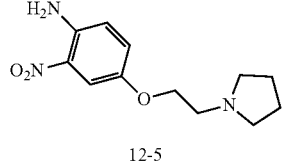
12-4

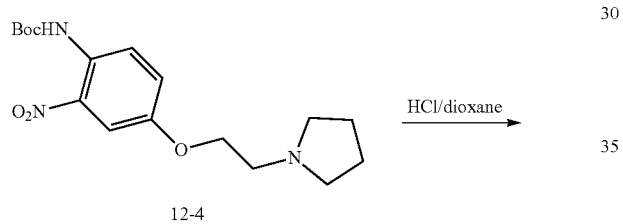
12-5

Step 3 to synthesize compound 12: A mixture of tert-butyl N-[2-nitro-4-(2-pyrrolidin-1-ylethoxy)phenyl]carbamate (1.2 g, 3.41 mmol), HCl/dioxane (4 M, 0.85 mL) in MeOH (20 mL) was stirred at 25° C. for 1 hr. The mixture was adjusted to pH=8 by addition of sat. aq. NaHCO$_3$ and the resulting mixture was concentrated to afford 2-nitro-4-(2-pyrrolidin-1-ylethoxy)aniline (1.0 g, crude) as a yellow solid. LCMS: $t_R$=0.882 min in 0-60 AB_2 min_220&254_Shimadzu.lcm, MS (ESI) m/z=252.1 [M+H]$^+$.

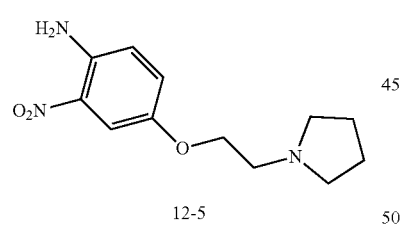
12-5

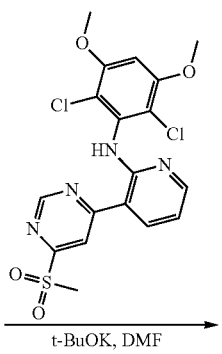

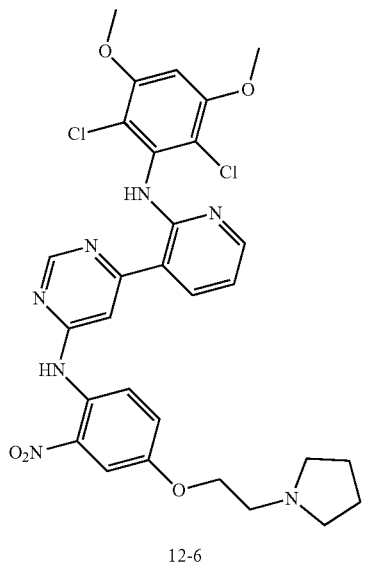
12-6

Step 4 to synthesize compound 12: To a solution of N-(2,6-dichloro-3,5-dimethoxy-phenyl)-3-(6-methylsulfonylpyrimidin-4-yl)pyridin-2-amine (352 mg, 0.659 mmol), 2-nitro-4-(2-pyrrolidin-1-ylethoxy)aniline (500 mg, 1.99 mmol) in DMF (30 mL) was added t-BuOK (223 mg, 1.99 mmol) at 0° C. Then the mixture was stirred at 40° C. for 2 hours under N$_2$ atmosphere. The mixture was extracted with EtOAc (150 mL×5). The combined organic layers were washed with H$_2$O (30 mL×6), dried over Na$_2$SO$_4$, filtered and concentrated under reduced pressure to give a residue. The residue was purified by flash silica gel chromatography (ISCO®; 12 g SepaFlash® Silica Flash Column, Eluent of 0-15% MeOH/DCM gradient @ 20 mL/min) to afford 6-[2-(2,6-dichloro-3,5-dimethoxy-anilino)-3-pyridyl]-N-[2-nitro-4-(2-pyrrolidin-1-ylethoxy)phenyl]pyrimidin-4-amine (539 mg, 69% yield, 53% purity) as a yellow solid. LCMS: $t_R$=1.004 min in 10-80 AB_2 min_220&254_Shimadzu.lcm, MS (ESI) m/z=626.1 [M+H]$^+$.

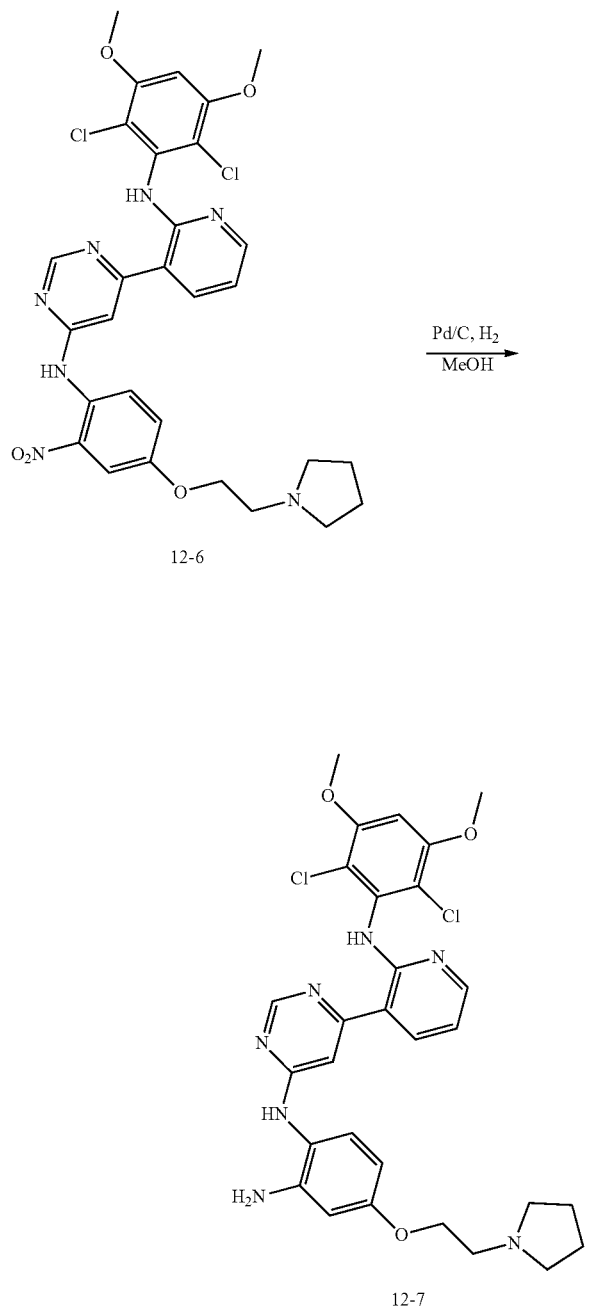

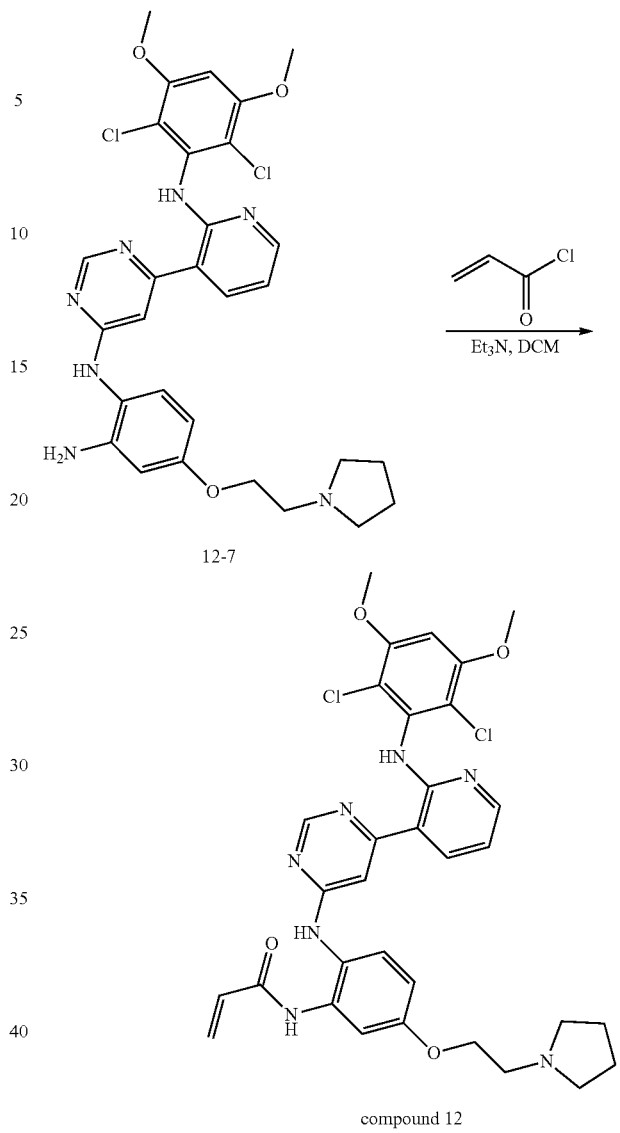

compound 12

Step 5 to synthesize compound 12: A mixture of 6-[2-(2,6-dichloro-3,5-dimethoxy-anilino)-3-pyridyl]-N-[2-nitro-4-(2-pyrrolidin-1-ylethoxy)phenyl]pyrimidin-4-amine (400 mg, 0.638 mmol,) and Pd/C (500 mg, 10% purity) in MeOH (30 mL) was stirred at 25° C. for 2 hours under $H_2$ atmosphere. The mixture was filtered and concentrated under reduced pressure to give a residue. The mixture was concentrated to afford $N_1$-[6-[2-(2,6-dichloro-3,5-dimethoxy-anilino)-3-pyridyl]pyrimidin-4-yl]-4-(2-pyrrolidin-1-ylethoxy)benzene-1,2-diamine (200 mg, crude) as a black solid. LCMS: $t_R$=1.218 min in 10-80 AB_4 min_220&254_Shimadzu.lcm, MS (ESI) m/z=596.3 $[M+H]^+$.

Step 6 to synthesize compound 12: To a solution of $N_1$-[6-[2-(2,6-dichloro-3,5-dimethoxy-anilino)-3-pyridyl]pyrimidin-4-yl]-4-(2-pyrrolidin-1-ylethoxy)benzene-1,2-diamine (150 mg, 0.251 mmol) in DCM (4 mL) and $Et_3N$ (28 mg, 0.277 mmol) was added a solution of prop-2-enoyl chloride (25 mg, 0.277 mmol) in DCM (3 mL) dropwise at 0° C. The mixture was stirred at 25° C. for 0.5 hour. The mixture was concentrated under reduced pressure to remove DCM. The residue was purified by preparative HPLC (Column: Xtimate C18 100*30 mm*3 um water (0.04% $NH_3 \cdot H_2O$+10 mM $NH_4HCO_3$)-ACN; B % from 63 to 83; Gradient Time: 30 min; Flow rate: 25 mL/min) to afford N-[2-[[6-[2-(2,6-dichloro-3,5-dimethoxy-anilino)-3-pyridyl]pyrimidin-4-yl]amino]-5-(2-pyrrolidin-1-ylethoxy)phenyl]prop-2-enamide (9.1 mg, 5% yield, 98% purity) as a white solid. LCMS: $t_R$=1.550 min in 10-80CD_4 min_220&254_Shimadzu.lcm, MS (ESI) m/z=650.2 $[M+H]^+$. $^1H$ NMR (400 MHz, DMSO-$d_6$): δ=10.95 (s, 1H), 9.64 (s, 1H), 8.94 (s, 1H), 8.61 (s, 1H), 8.05-7.95 (m, 2H), 7.45-7.38 (m, 2H), 6.94-6.81 (m, 4H), 6.55-6.48 (m, 1H), 6.25-6.21 (m, 1H), 5.72 (d, J=11.2 Hz, 1H), 4.07 (t, J=5.6 Hz, 2H), 3.92 (s, 6H), 2.89-2.73 (m, 6H), 1.69 (s, 4H).

Example 9

Synthesis of Compound 13

N-[5-[[6-[2-(2,6-dichloro-3,5-dimethoxy-anilino)-3-pyridyl]pyrimidin-4-yl]amino]-1-methyl-imidazol-4-yl]prop-2-enamide

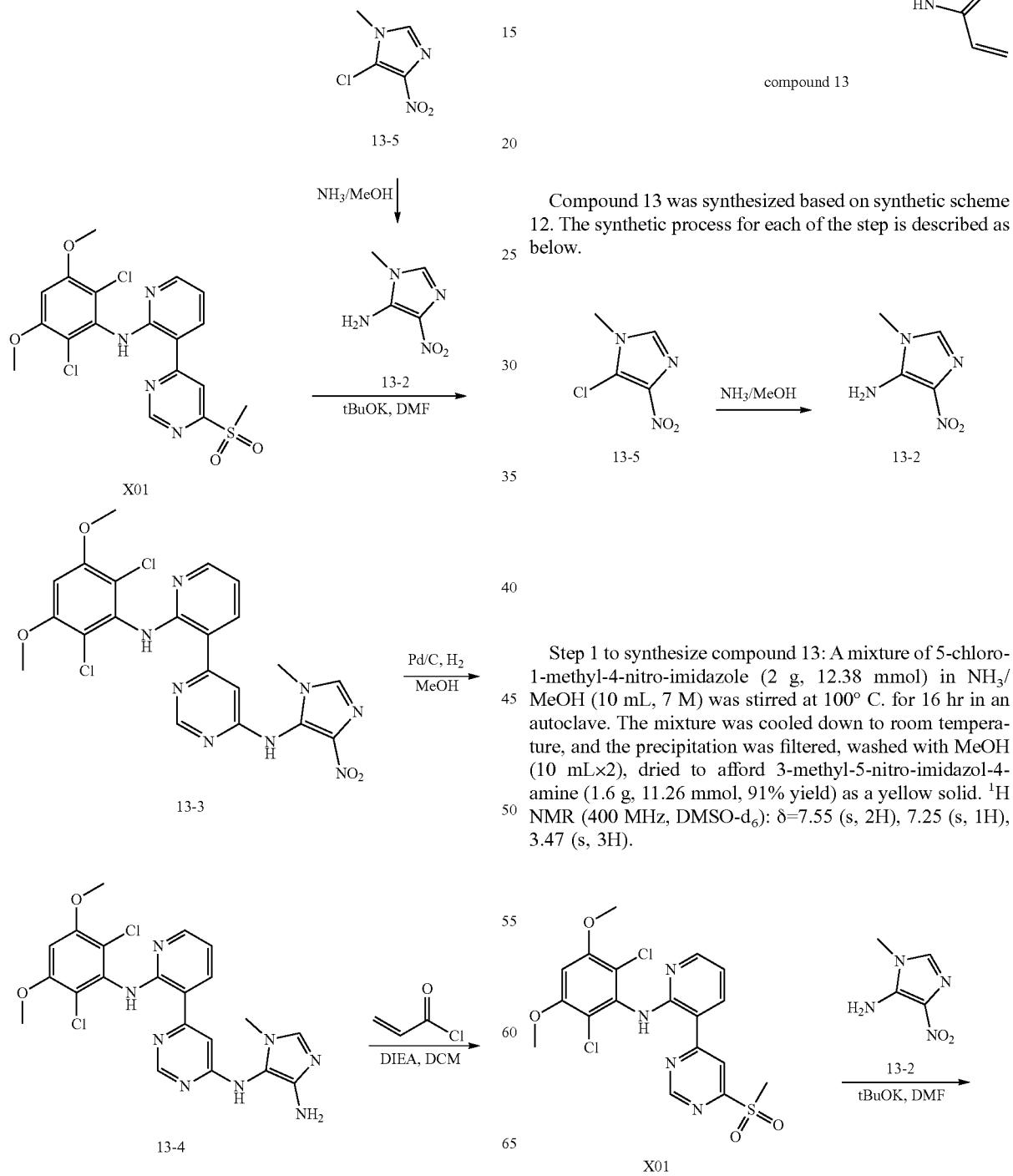

compound 13

Compound 13 was synthesized based on synthetic scheme 12. The synthetic process for each of the step is described as below.

Step 1 to synthesize compound 13: A mixture of 5-chloro-1-methyl-4-nitro-imidazole (2 g, 12.38 mmol) in $NH_3$/MeOH (10 mL, 7 M) was stirred at 100° C. for 16 hr in an autoclave. The mixture was cooled down to room temperature, and the precipitation was filtered, washed with MeOH (10 mL×2), dried to afford 3-methyl-5-nitro-imidazol-4-amine (1.6 g, 11.26 mmol, 91% yield) as a yellow solid. $^1$H NMR (400 MHz, DMSO-$d_6$): δ=7.55 (s, 2H), 7.25 (s, 1H), 3.47 (s, 3H).

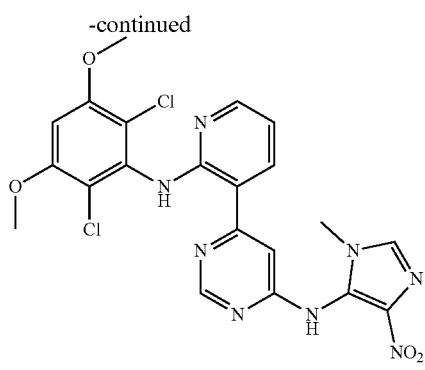

13-3

Step 2 to synthesize compound 13: To a solution of N-(2,6-dichloro-3,5-dimethoxy-phenyl)-3-(6-methylsulfonylpyrimidin-4-yl)pyridin-2-amine (500 mg, 1.10 mmol) and 3-methyl-5-nitro-imidazol-4-amine (312 mg, 2.20 mmol) in DMF (20 mL) was added tBuOK (246 mg, 2.20 mmol). The mixture was stirred at 40° C. for 12 hr under $N_2$ atmosphere. The mixture was diluted with $H_2O$ (20 mL) and extracted with EtOAc (10 mL×2). The combined organic layers were washed with $H_2O$ (10 mL×3), dried over $Na_2SO_4$, filtered and concentrated under reduced pressure to give a residue. The residue was purified by flash silica gel chromatography (ISCO®; 12 g SepaFlash® Silica Flash Column, Eluent of 0~10% Ethyl acetate/Petroleum ether gradient @ 50 mL/min) to afford 6-[2-(2,6-dichloro-3,5-dimethoxy-anilino)-3-pyridyl]-N-(3-methyl-5-nitro-imidazol-4-yl)pyrimidin-4-amine (320 mg, 0.619 mmol, 56% yield) as a yellow solid.

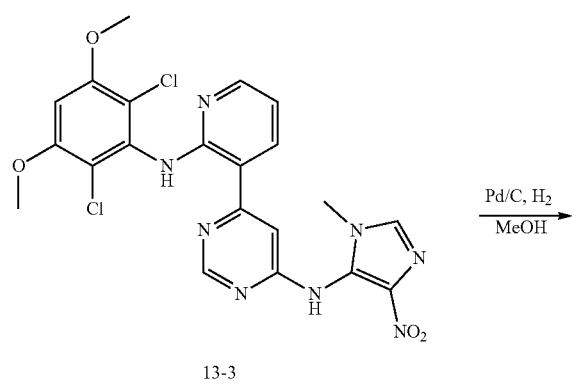

13-3

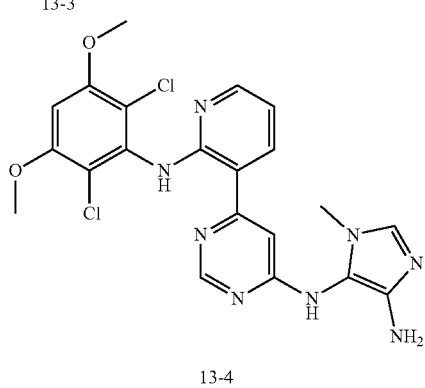

13-4

Step 3 to synthesize compound 13: To a solution of 6-[2-(2,6-dichloro-3,5-dimethoxy-anilino)-3-pyridyl]-N-(3-methyl-5-nitro-imidazol-4-yl)pyrimidin-4-amine (300 mg, 0.58 mmol) in MeOH (5 mL) was added Pd/C (5 mg, 10% purity) under $N_2$ atmosphere. The suspension was degassed and purged with $H_2$ for 3 times. The mixture was stirred under $H_2$ (15 psi) at 25° C. for 2 hr. The liquid was filtered with diatomite, and the filtrate was concentrated under reduced pressure to afford $N_5$-[6-[2-(2,6-dichloro-3,5-dimethoxy-anilino)-3-pyridyl]pyrimidin-4-yl]-1-methyl-imidazole-4,5-diamine (200 mg, 0.41 mmol, 71% yield) as a brown solid.

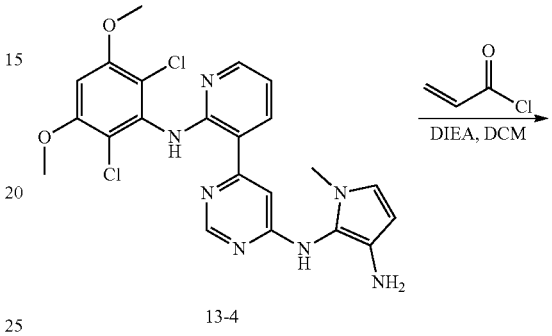

13-4

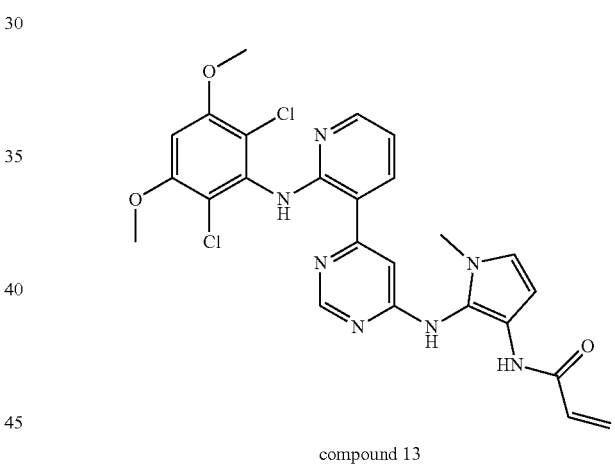

compound 13

Step 4 to synthesize compound 13: To a solution of $N_5$-[6-[2-(2,6-dichloro-3,5-dimethoxy-anilino)-3-pyridyl]pyrimidin-4-yl]-1-methyl-imidazole-4,5-diamine (100 mg, 0.205 mmol) in DCM (10 mL) and DIEA (53 mg, 0.41 mmol) was added prop-2-enoyl chloride (15 mg, 0.164 mmol) at 0° C. The mixture was stirred at 0° C. for 0.5 hr. The mixture was concentrated under reduced pressure and the residue was purified by preparative HPLC (Column: Phenomenex Luna C18 100*40 mm*3 um; water (0.225% FA)-ACN; B % from 20 to 40; Gradient time: 9 min; Flow rate: 25 mL/min) to afford N-[5-[[6-[2-(2,6-dichloro-3,5-dimethoxy-anilino)-3-pyridyl]pyrimidin-4-yl]amino]-1-methyl-imidazol-4-yl]prop-2-enamide (13.6 mg, 0.024 mmol, 12% yield, 95.34% purity) as a yellow solid. LCMS: $t_R$=0.968 min in 10-80AB_4 min_220&254_Shimadzu.lcm, MS (ESI) m/z=541.2 [M+H]$^+$. $^1$H NMR (400 MHz, DMSO-$d_6$): δ=10.99 (s, 1H), 10.45 (s, 1H), 9.26 (s, 1H), 8.72 (s, 1H), 8.13-8.09 (m, 2H), 7.21-6.86 (m, 3H), 6.43-6.23 (m, 2H), 5.79-5.76 (m, 1H), 4.04 (s, 6H), 3.55 (s, 3H).

Example 10

Synthesis of Compound 14

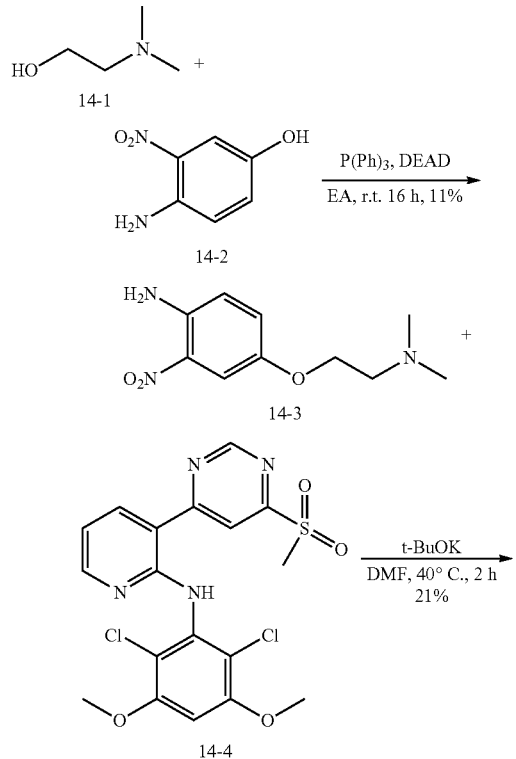

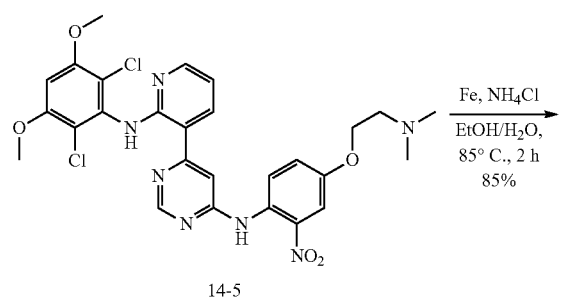

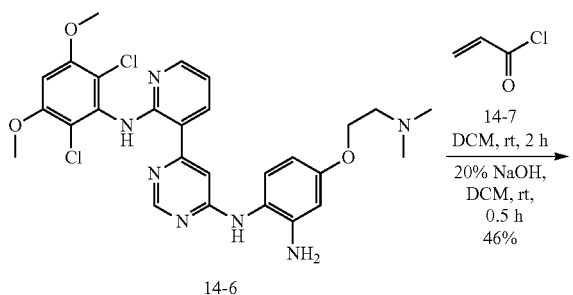

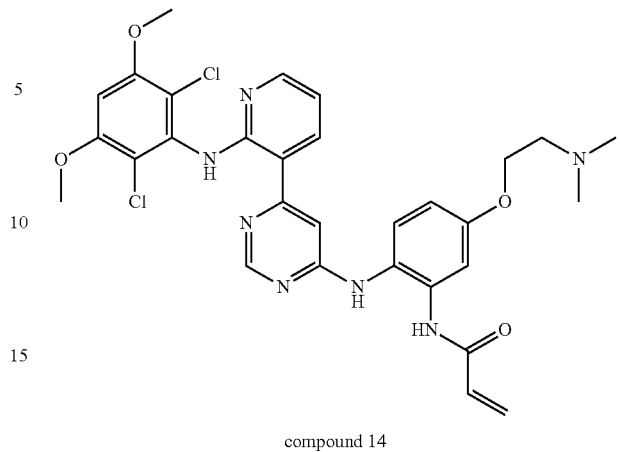

compound 14

Compound 14 was synthesized based on synthetic scheme 13. The synthetic process for each of the step is described as below.

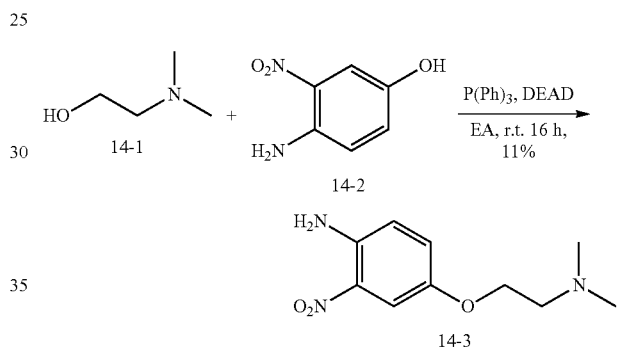

Step 1 to synthesize compound 14: To the mixture of compound 14-2 (30.0 g, 194.8 mmol, 1.0 eq) in ethyl acetate (600 mL) was added compound 14-1 (19 g, 214 mmol, 1.1 eq) and triphenylphosphine (56.0 g, 214.1 mmol, 1.1 eq). Then diethyl azodicarboxylate (33.5 mL, 214.1 mmol, 1.1 eq) was added dropwise. The mixture was stirred at room temperature overnight. The reaction was monitored by TLC. Then the mixture was filtered through a pad of Celite and sintered funnel. The result mixture was extracted with ethyl acetate (3×600 mL) and added 1N HCl and water. The aqueous phase was extracted with ethyl acetate and ammonium hydroxide. The combined organic phase was dried over anhydrous sodium sulfate and concentrated under reduced pressure. The residue was purified by column chromatography on a silica gel (dichloromethane:methanol, 100:1-50:1-30:1) to give compound 14-3 (4.6 g, 11%).

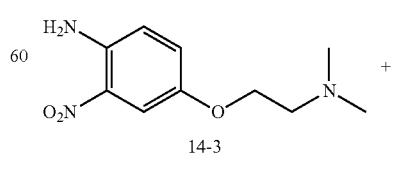

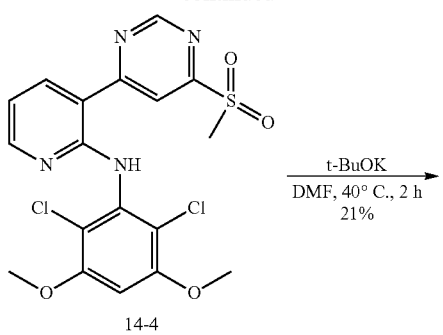

14-4

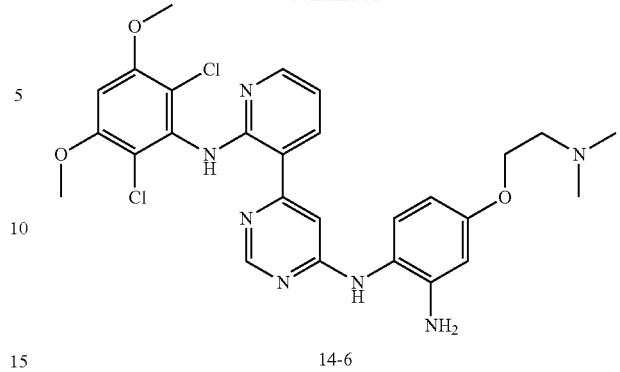

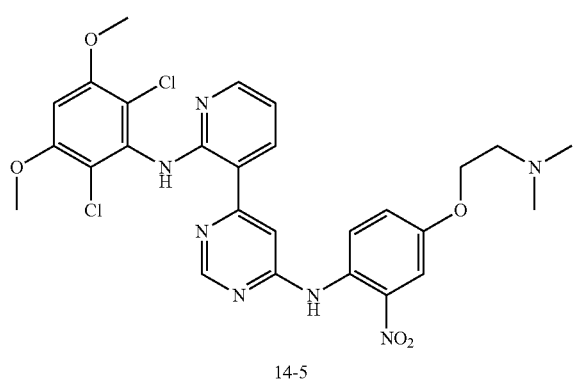

14-5

Step 2 to synthesize compound 14: To the mixture of compound 14-3 (10.0 g, 44.4 mmol, 1.1 eq) and compound 14-4 (18.4 g, 40.4 mmol, 1.0 eq) in dimethylformamide (60 mL) was added potassium tert-butoxide (13.6 g, 121.2 mmol, 3.0 eq) under nitrogen atmosphere. Then the mixture was stirred at 40° C. for 2 h. TLC analysis of the reaction mixture showed partial conversion to the desired product. The mixture was cooled to room temperature and extracted with ethyl acetate and water. The combined organics were washed with brine, dried over anhydrous sodium sulfate and concentrated under reduced pressure. The residue was purified by column chromatography on a silica gel (dichloromethane:methanol, 100:1-50:1) to afford compound 14-5 (5 g, 21%).

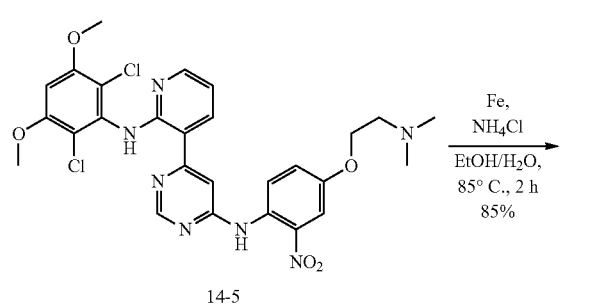

14-5

14-6

Step 3 to synthesize compound 14: To the mixture of compound 14-5 (5.0 g, 8.3 mmol, 1.0 eq) in ethanol/water (100 mL/20 mL) was added Fe (2.33 g, 41.7 mmol, 5.0 eq) and ammonium chloride (4.46 g, 83.4 mmol, 10.0 eq). Then the mixture was stirred at 85° C. for 2 h. TLC analysis of the reaction mixture showed partial conversion to the desired product. The mixture was filtered and extracted with ethyl acetate (120 mL×3). The combined organics were washed with brine, dried over anhydrous sodium sulfate and concentrated under reduced pressure. The residue was purified by column chromatography on a silica gel (dichloromethane:methanol, 10:1) to afford compound 14-6 (4 g, 85%).

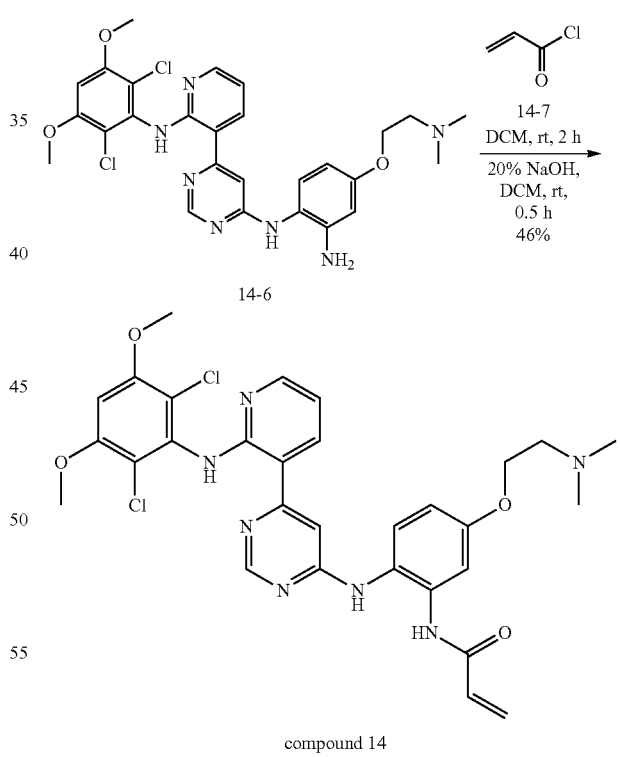

compound 14

Step 4 to synthesize compound 14: To the mixture of compound 14-6 (4.0 g, 7.03 mmol, 1.0 eq) in dichloromethane (40 mL) was added compound 14-7 (632.6 mg, 7.03 mmol, 1.0 eq) at 0° C. The mixture was stirred at room temperature for 2 h. TLC analysis of the reaction mixture showed full conversion to the desired product. Then the mixture was quenched with water (200 mL) and extracted with dichloromethane (40 mL×2). The combined organic layer was dried over anhydrous sodium sulfate and concentrated under reduced pressure. The residue was purified by column chromatography on a silica gel (dichloromethane:methanol, 10:1) to afford the crude product (purity: 90%). The crude product was dissolved in dichloromethane (50 mL). Then the mixture was added 20% sodium hydroxide solution (10 mL). The mixture was stirred at room temperature for 30 min. Then the mixture was extracted with dichloromethane and washed with brine. The combined organic layer was dried over anhydrous sodium sulfate and concentrated under reduced pressure to give compound 14 (2.0 g, 46%) as yellow solid. LCMS: [M+1]$^+$ 624. $^1$H NMR (400 MHz, DMSO): δ 10.94 (s, 1H), 8.58 (s, 1H), 8.02-8.01 (m, 1H), 7.92 (m, 1H), 7.43 (m, 1H), 7.39-7.37 (m, 1H), 6.96 (m, 1H), 6.80-6.78 (m, 3H), 6.76 (m, 1H), 6.46 (m, 1H), 6.17 (m, 1H), 5.73 (s, 1H), 5.69-5.66 (m, 1H), 4.03-4.00 (m, 3H), 3.90 (s, 8H), 2.61-2.59 (m, 3H) and 2.19 (s, 8H).

Example 11

Synthesis of Compound 15

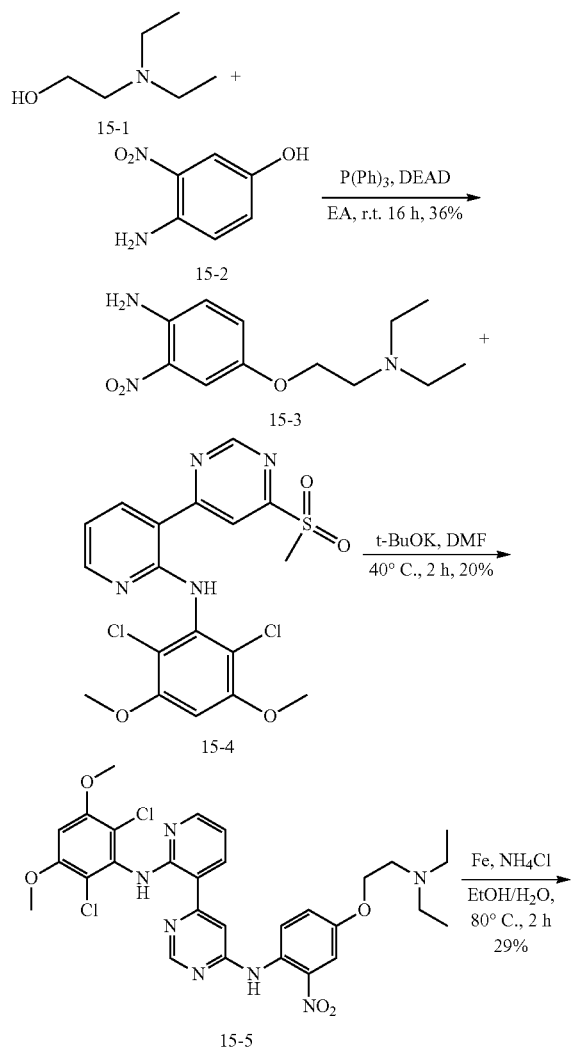

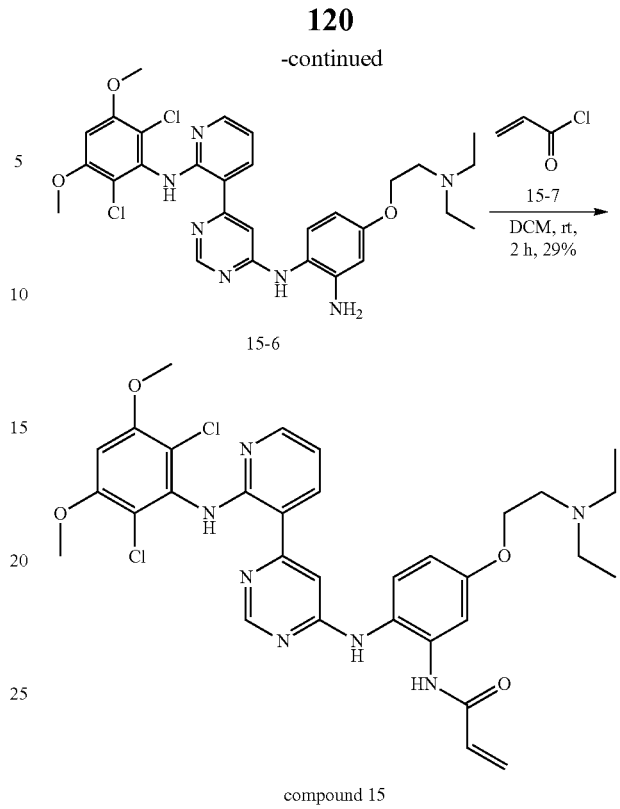

compound 15

Compound 15 was synthesized based on synthetic scheme 14. The synthetic process for each of the step is described as below.

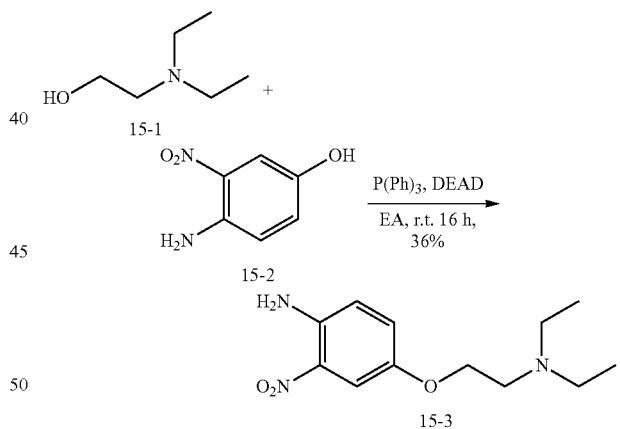

Step 1 to synthesize compound 15: To the mixture of compound 15-2 (30.0 g, 194.6 mmol, 1.0 eq) in ethyl acetate (600 mL) was added compound 15-1 (25.1 g, 214 mmol, 1.1 eq) and triphenylphosphine (56.0 g, 214.1 mmol, 1.1 eq). Then diethyl azodicarboxylate (33.5 mL, 214.1 mmol, 1.1 eq) was added dropwise. The mixture was stirred at room temperature overnight. The reaction was monitored by TLC. Then the mixture was filtered through a pad of celite and sintered funnel. The result mixture was extracted with ethyl acetate (3×600 mL) and added 1N HCl and water. The aqueous phase was extracted with ethyl acetate and ammonium hydroxide. The combined organic phase was dried over anhydrous sodium sulfate and concentrated under reduced pressure. The residue was purified by column chromatography on a silica gel (dichloromethane:methanol, 100:1~50:1~30:1) to give compound 15-3 (17.5 g, 36%).

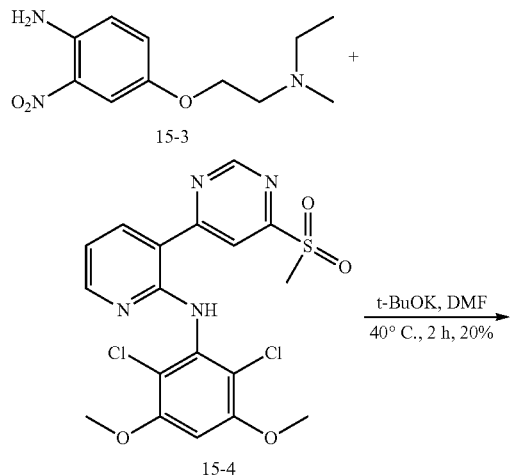

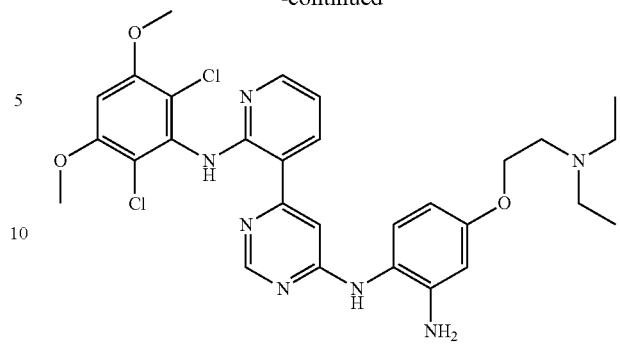

Step 2 to synthesize compound 15: To the mixture of compound 15-3 (2.2 g, 8.8 mmol, 2.0 eq) and compound 15-4 (2.0 g, 4.4 mmol, 1.0 eq) in dimethylformamide (30 mL) was added potassium tert-butoxide (1.48 g, 13.2 mmol, 3.0 eq) under nitrogen atmosphere. Then the mixture was stirred at 40° C. for 2 h. TLC analysis of the reaction mixture showed partial conversion to the desired product. The mixture was cooled to room temperature and extracted with ethyl acetate and water. The combined organics were washed with brine, dried over anhydrous sodium sulfate and concentrated under reduced pressure. The residue was purified by column chromatography on a silica gel (dichloromethane:methanol, 100:1-50:1) to afford compound 15-5 (550 mg, 20%).

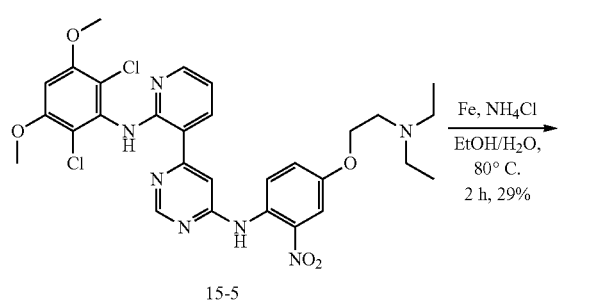

Step 3 to synthesize compound 15: To the mixture of compound 15-5 (1.0 g, 1.6 mmol, 1.0 eq) in ethanol/water (20 mL/4 mL) was added Fe (446 mg, 8.0 mmol, 5.0 eq) and ammonium chloride (880 mg, 16 mmol, 10.0 eq). Then the mixture was stirred at 80° C. for 2 h. TLC analysis of the reaction mixture showed partial conversion to the desired product. The mixture was filtered and extracted with ethyl acetate (20 mL×3). The combined organics were washed with brine, dried over anhydrous sodium sulfate and concentrated under reduced pressure. The residue was purified by column chromatography on a silica gel (dichloromethane:methanol, 10:1) to afford compound 15-6 (280 mg, 29%).

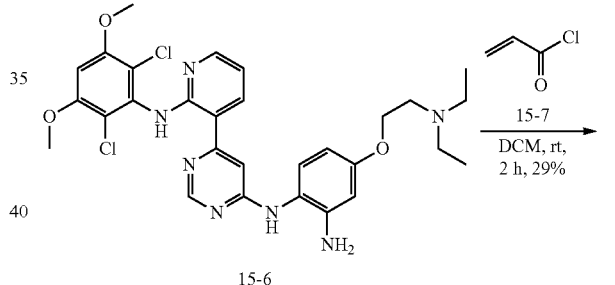

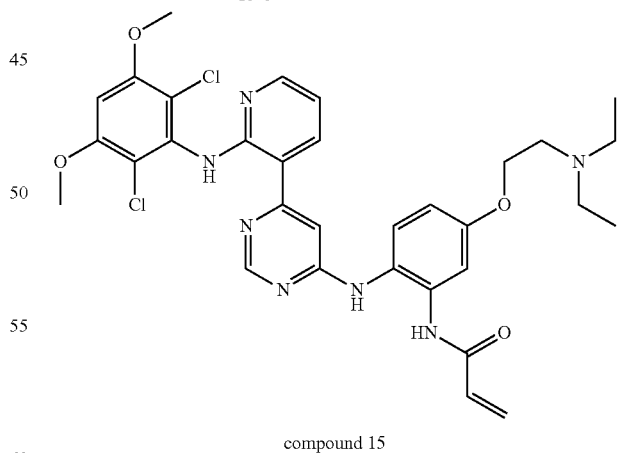

Step 4 to synthesize compound 15: To the mixture of compound 15-6 (280 mg, 0.47 mmol, 1.0 eq) in dichloromethane (5 mL) was added compound 15-7 (42.5 mg, 0.47 mmol, 1.0 eq) at 0° C. The mixture was stirred at room temperature for 2 h. TLC analysis of the reaction mixture showed full conversion to the desired product. Then the mixture was quenched with water (20 mL) and extracted with dichloromethane (5 mL×2). The combined organic layer was dried over anhydrous sodium sulfate and concentrated under reduced pressure. The residue was purified by column chromatography on a silica gel (dichloromethane: methanol, 10:1) to afford compound 15 (81 mg, 29%) as yellow solid. LCMS: [M+1]$^+$652. $^1$H NMR (400 MHz, CDCl$_3$): δ 11.12 (s, 1H), 9.30 (s, 1H), 8.62 (s, 1H), 8.40 (m, 1H), 8.12 (m, 1H), 7.85 (m, 1H), 7.38 (m, 1H), 7.25 (m, 1H), 7.00 (s, 1H), 6.66 (m, 1H), 6.45 (m, 2H), 6.38-6.35 (m, 4H), 5.71-5.69 (m, 1H), 3.34 (s, 2H), 3.89 (s, 8H), 3.46 (s, 1H), 3.34 (m, 2H), 3.17 (m, 5H) and 1.38-1.35 (m, 8H).

Example 12

Synthesis of Compound 16

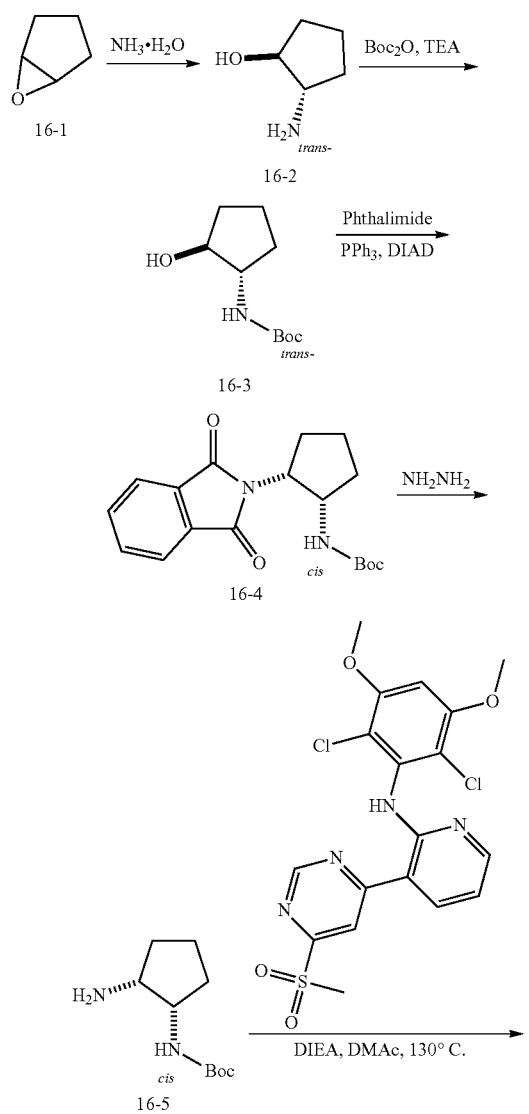

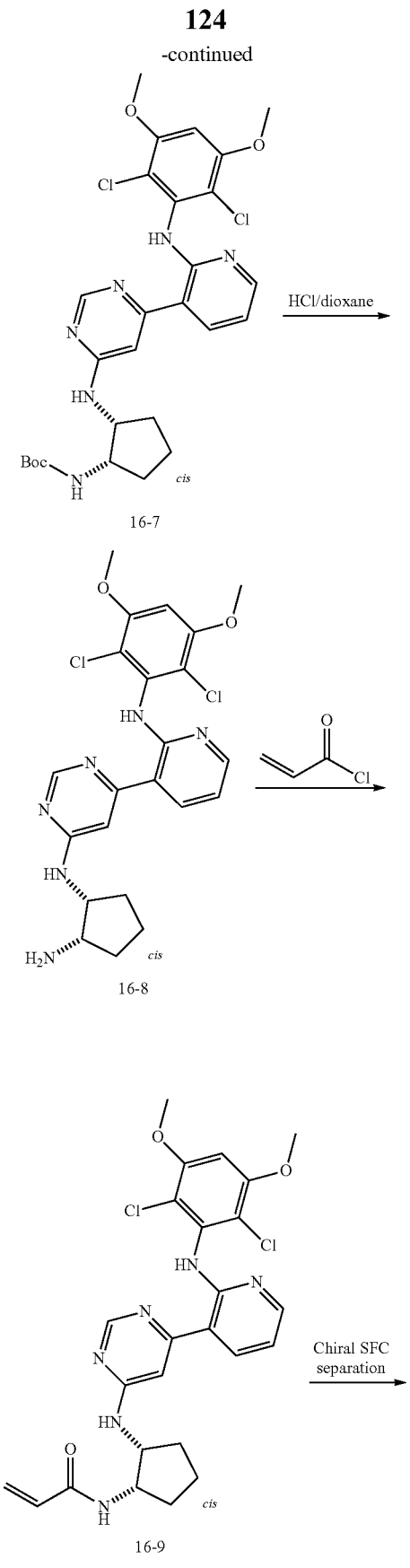

-continued

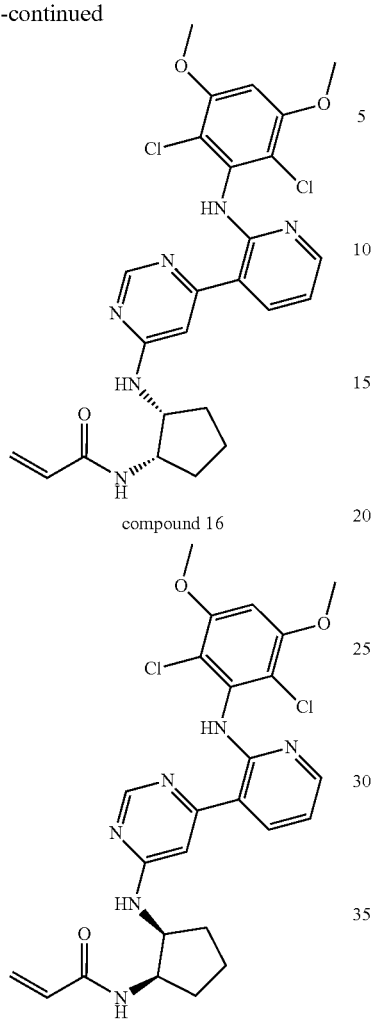

compound 16

Compound 16 was synthesized based on synthetic scheme 15. The synthetic process for each of the step is described as below.

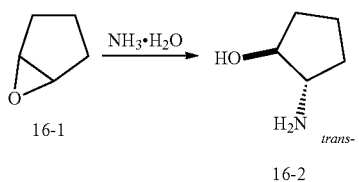

Step 1 to synthesize compound 16: To a solution of 6-oxabicyclo[3.1.0]hexane (7 g, 83.22 mmol) in i-PrOH (40 mL) was added NH₃·H₂O (35.00 g, 249.65 mmol 25% purity). The mixture was stirred at 60° C. for 16 hr in a sealed tube. The mixture was concentrated under reduced pressure to afford trans-2-aminocyclopentanol (26 g, crude) as a brown oil. ¹H NMR (400 MHz, DMSO-d₆): δ=3.68-3.53 (m, 1H), 2.88-2.77 (m, 1H), 1.82-1.77 (m, 2H), 1.58-1.53 (m, 2H), 1.44-1.40 (m, 1H), 1.22-1.16 (m, 1H).

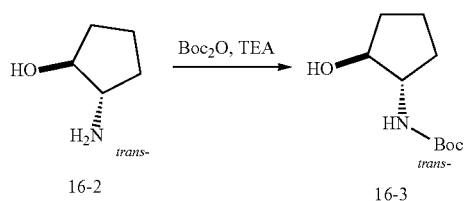

Step 2 to synthesize compound 16: To a solution of trans-2-aminocyclopentanol (22 g, 217.51 mmol) in THE (220 mL) was added TEA (26.41 g, 261.01 mmol) and Boc₂O (52.22 g, 239.26 mmol, 54.97 mL, 1.1 eq). The mixture was stirred at 15° C. for 16 hr. The mixture was concentrated under reduced pressure to remove THF. The residue was diluted with EtOAc (20 mL) and extracted with H₂O (20 mL×3), dried over Na₂SO₄, filtered and concentrated under reduced pressure to give a residue. The residue was purified by flash silica gel chromatography (ISCO®; 80 g SepaFlash® Silica Flash Column, Eluent of 0~30% Ethyl acetate/Petroleum ether gradient @ 60 mL/min) to afford tert-butyl N-[trans-2-hydroxycyclopentyl]carbamate (14 g, 69.56 mmol, 32% yield) as a white solid. ¹H NMR (400 MHz, DMSO-d₆): δ=6.72 (d, J=6.4 Hz, 1H), 4.60 (s, 1H), 3.80-3.75 (m, 1H), 3.49 (br, 1H), 1.86-1.54 (m, 4H), 1.38 (s, 9H), 1.32-1.29 (m, 2H).

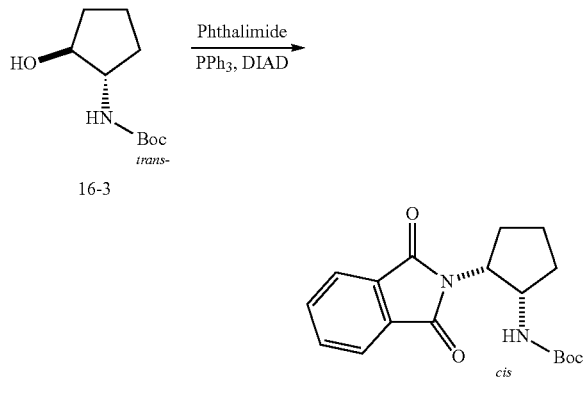

Step 3 to synthesize compound 16: A mixture of tert-butyl N-[trans-2-hydroxycyclopentyl]carbamate (14 g, 69.56 mmol), isoindoline-1,3-dione (11.26 g, 76.52 mmol), PPh₃ (20.07 g, 76.52 mmol) and DIAD (16.18 g, 80.00 mmol) in THE (150 mL) was degassed and purged with N₂ for 3 times, and then the mixture was stirred at 0° C. for 1 hr. The mixture was concentrated under reduced pressure to remove THF. The residue was diluted with H₂O (150 mL), and extracted with EtOAc (150 mL×3), dried over Na₂SO₄, filtered and concentrated under reduced pressure to give a residue. The residue was purified by flash silica gel chromatography (ISCO®; 80 g SepaFlash® Silica Flash Column, Eluent of 0~30% Ethyl acetate/Petroleum ether gradient @ 80 mL/min). The crude product was further re-crystallization from EtOH (100 mL) at 80° C., then the precipitation was filtered, dried to afford tert-butyl N-[cis-2-(1,3-dioxoisoindolin-2-yl)cyclopentyl]carbamate (15 g, 45.40 mmol, 65% yield) as a white solid. ¹H NMR (400 MHz, DMSO-d₆): δ=7.83-7.8 (m, 5H), 6.67 (d, J=7.6 Hz, 1H), 4.49-4.45 (m, 1H), 1.92-1.41 (m, 6H), 1.01 (s, 9H).

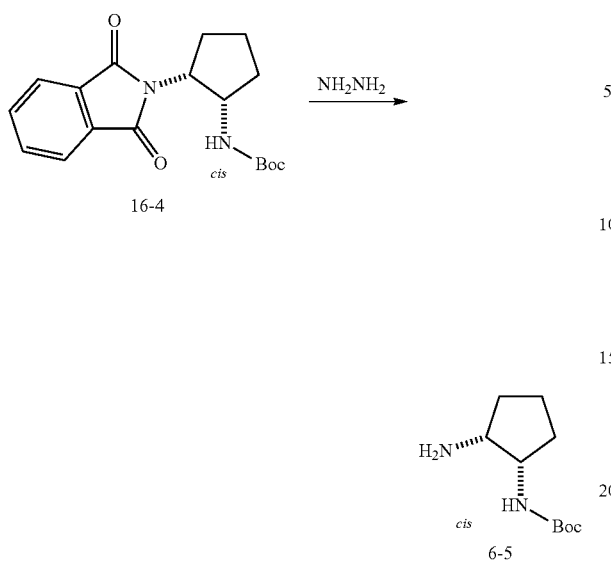

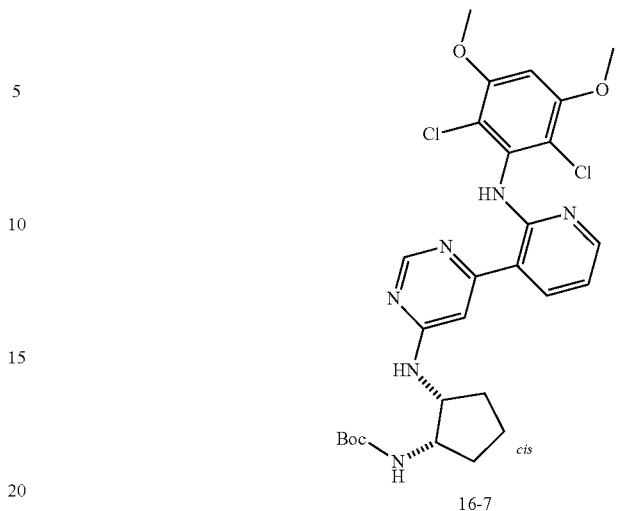

Step 4 to synthesize compound 16: To a solution of tert-butyl N-[cis-2-(1,3-dioxoisoindolin-2-yl)cyclopentyl]carbamate (5 g, 15.13 mmol) in MeOH (50 mL) was added $NH_2NH_2$ (709 mg, 16.65 mmol, 80% purity). The mixture was stirred at 50° C. for 1.5 hr. The mixture was concentrated under reduced pressure to remove MeOH. The residue was diluted with $H_2O$ (50 mL), then extracted with EtOAc (50 mL×3), dried over $Na_2SO_4$, filtered and concentrated to afford tert-butyl N-[cis-2-aminocyclopentyl]carbamate (1.1 g, 5.49 mmol, 36% yield) as a yellow oil.

Step 5 to synthesize compound 16: To a solution of N-(2,6-dichloro-3,5-dimethoxy-phenyl)-3-(6-methylsulfonylpyrimidin-4-yl)pyridin-2-amine (758 mg, 1.66 mmol) and tert-butyl N-[cis-2-aminocyclopentyl]carbamate (1 g, 4.99 mmol) in DMAc (10 mL) was added DIEA (430 mg, 3.33 mmol). The mixture was stirred at 130° C. for 12 hr. The mixture was diluted with $H_2O$ (20 mL) and extracted with EtOAc (20 mL×3), dried over $Na_2SO_4$, filtered and concentrated under reduced pressure to give a residue. The residue was purified by flash silica gel chromatography (ISCO®; 12 g SepaFlash® Silica Flash Column, Eluent of 0-30% Ethyl acetate/Petroleum ether gradient @ 40 mL/min) to afford tert-butyl N-[2-[[6-[2-(2,6-dichloro-3,5-dimethoxy-anilino)-3-pyridyl]pyrimidin-4-yl]amino]cyclopentyl]carbamate (cis mixture, 500 mg, 0.869 mmol, 52% yield) as a yellow solid. LCMS: $t_R$=1.412 min in 10-80AB_2 min_220&254_Shimadzu.lcm, MS (ESI) m/z=575.2 $[M+H]^+$.

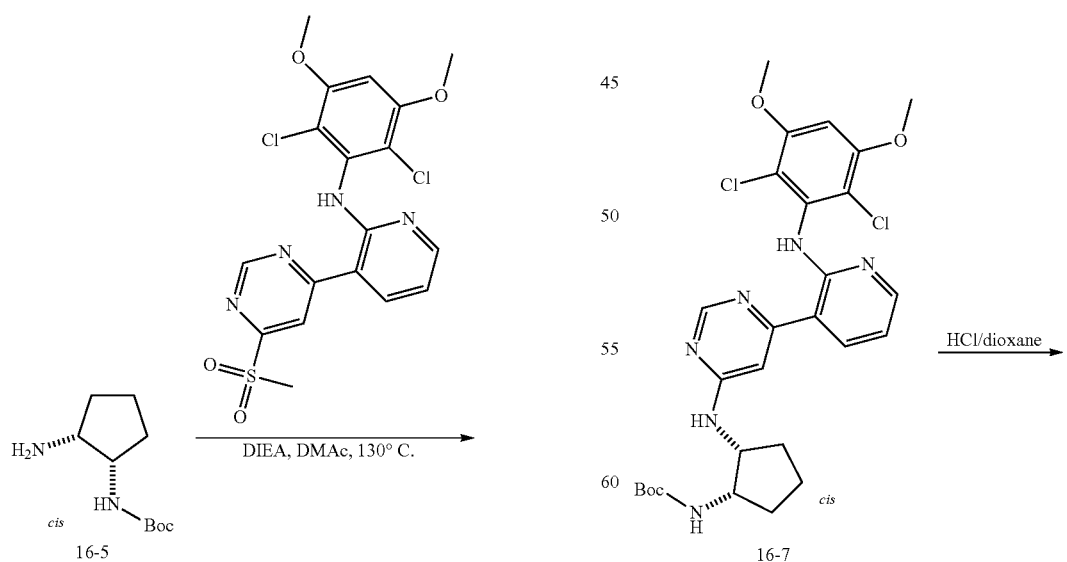

129
-continued

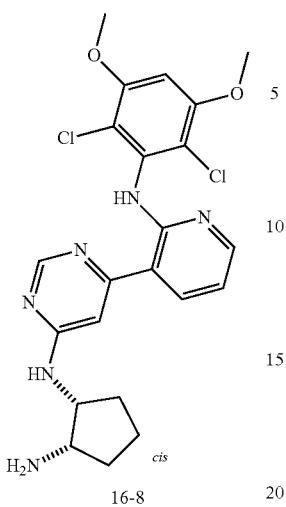

16-8

Step 6 to synthesize compound 16: A solution of tert-butyl N-[2-[[6-[2-(2,6-dichloro-3,5-dimethoxy-anilino)-3-pyridyl]pyrimidin-4-yl]amino]cyclopentyl]carbamate (500 mg, 0.868 mmol, cis mixture) in HCl/dioxane (4 M, 10 mL) was stirred at 25° C. for 0.5 hr. The mixture was concentrated to afford $N_1$-[6-[2-(2,6-dichloro-3,5-dimethoxy-anilino)-3-pyridyl]pyrimidin-4-yl]cyclopentane-1,2-diamine (800 mg, crude) as a white solid.

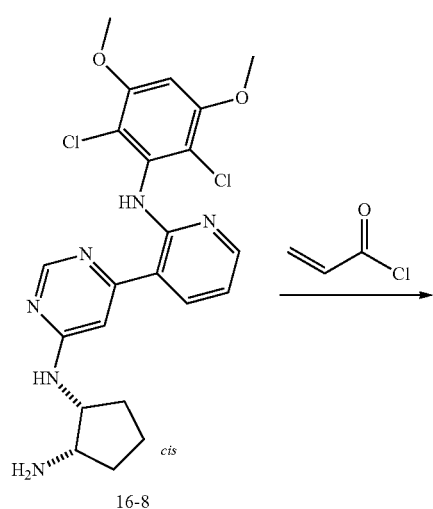

16-8

130
-continued

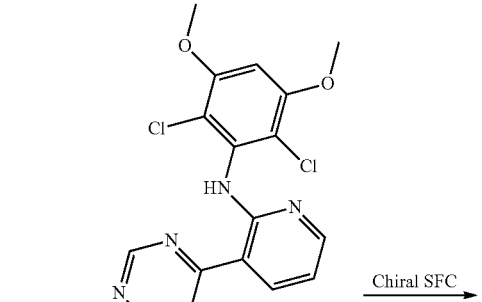

16-9

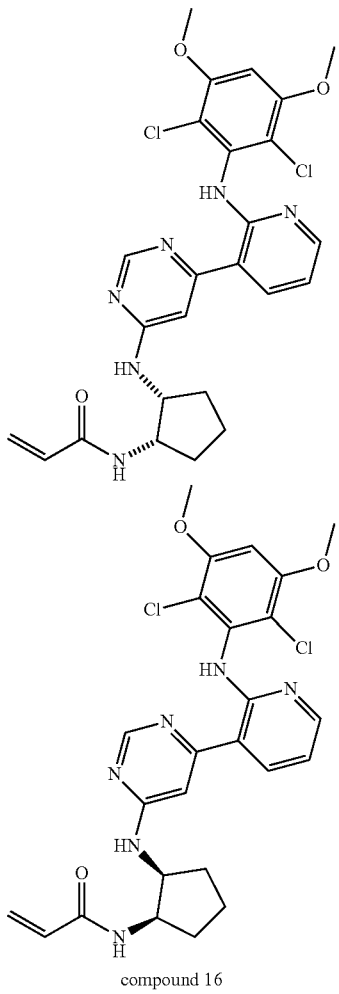

compound 16

Step 7 to synthesize compound 16: To a solution of $N_1$-[6-[2-(2,6-dichloro-3,5-dimethoxy-anilino)-3-pyridyl]pyrimidin-4-yl]cyclopentane-1,2-diamine (700 mg, 1.47 mmol, cis mixture) in DCM (10 mL) was added DIEA (190 mg, 1.47 mmol) and prop-2-enoyl chloride (67 mg, 0.736 mmol). The mixture was stirred at 0° C. for 0.5 hr. The residue was diluted with H$_2$O (20 mL) and extracted with EtOAc (20 mL×3), dried over Na$_2$SO$_4$, filtered and concentrated under reduced pressure to give a residue. The residue was purified by flash silica gel chromatography (ISCO®; 12 g SepaFlash® Silica Flash Column, Eluent of 0~10% dichloromethane/Petroleum ether gradient @ 40 mL/min) to give desired product (170 mg, 94% purity) as a white solid, which was further separated by SFC (column: DAICEL CHIRALPAK AD (250 mm*30 mm, 10 um); mobile phase: [0.1% $NH_3 \cdot H_2O$ ETOH]; B %: 35%-35%, 30 min) to afford (+) N-[cis-2-[[6-[2-(2,6-dichloro-3,5-dimethoxy-anilino)-3-pyridyl]pyrimidin-4-yl]amino]cyclopentyl]prop-2-enamide (43.7 mg, 0.081 mmol, 98.85% purity, single cis isomer) and (−) N-[cis-2-[[6-[2-(2,6-dichloro-3,5-dimethoxy-anilino)-3-pyridyl]pyrimidin-4-yl]amino]cyclopentyl]prop-2-enamide (46.5 mg, 0.087 mmol, 99.10% purity, single cis isomer) as a white solid.

(+)N-[cis-2-[[6-[2-(2,6-dichloro-3,5-dimethoxy-anilino)-3-pyridyl]pyrimidin-4-yl]amino]cyclopentyl]prop-2-enamide (the first peak in chiral SFC). LCMS: $t_R$=1.476 min in 10-80AB_4 min_220&254_Shimadzu.lcm, MS (ESI) m/z=529.2 $[M+H]^+$. $^1H$ NMR (400 MHz, DMSO-$d_6$): δ=11.09 (s, 1H), 8.48 (s, 1H), 8.04-8.02 (m, 3H), 7.27 (d, J=8.0 Hz, 1H), 6.97 (s, 1H), 6.87-6.83 (m, 2H), 6.17 (s, 1H), 6.05-5.95 (m, 1H), 5.48 (s, 1H), 4.41-4.25 (m, 2H), 3.93 (s, 6H), 2.02-1.57 (m, 6H). Chiral SFC: $t_R$=5.118 min (Instrument column: Chiralpak AD-3 100×4.6 mm I.D., 3 um, Mobile phase: A: $CO_2$ B:ethanol (0.05% DEA), Gradient: from 5% to 40% of B in 4.5 min and hold 40% for 2.5 min, then 5% of B for 1 min; Flow rate: 2.8 mL/min Column temperature: 40° C.; UV detection: 220 nm), ee %=99%. $[α]_D^{20}$=+13 (c=0.10, MeOH).

(−)N-[cis-2-[[6-[2-(2,6-dichloro-3,5-dimethoxy-anilino)-3-pyridyl]pyrimidin-4-yl]amino]cyclopentyl]prop-2-enamide (the second peak in chiral SFC). LCMS: $t_R$=1.481 min in 10-80AB_4 min_220&254_Shimadzu.lcm, MS (ESI) m/z=529.2 $[M+H]^+$. $^1H$ NMR (400 MHz, DMSO-$d_6$): δ=11.09 (s, 1H), 8.48 (s, 1H), 8.04-8.02 (m, 3H), 7.27 (d, J=8.0 Hz, 1H), 6.97 (s, 1H), 6.87-6.83 (m, 2H), 6.16 (s, 1H), 6.05-5.95 (m, 1H), 5.48 (s, 1H), 4.41-4.25 (m, 2H), 3.93 (s, 6H), 2.02-1.57 (m, 6H). Chiral SFC: $t_R$=6.002 min (Instrument column: Chiralpak AD-3 100×4.6 mm I.D., 3 um, Mobile phase: A: $CO_2$ B:ethanol (0.05% DEA), Gradient: from 5% to 40% of B in 4.5 min and hold 40% for 2.5 min, then 5% of B for 1 min; Flow rate: 2.8 mL/min Column temperature: 40° C.; UV detection: 220 nm), ee %=99.1%. $[α]_D^{20}$=−13 (c=0.10, MeOH).

Example 13

Evaluation of the In Vitro Efficacy of FGFR Inhibitors inventive compound 1

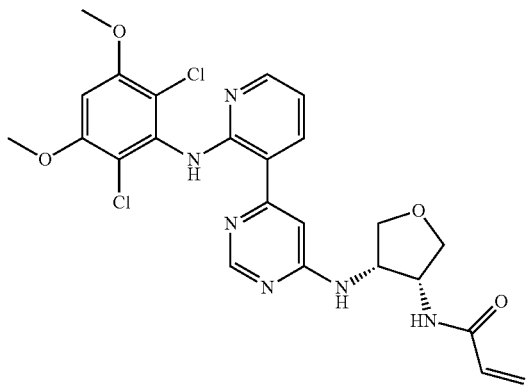

control compound 5

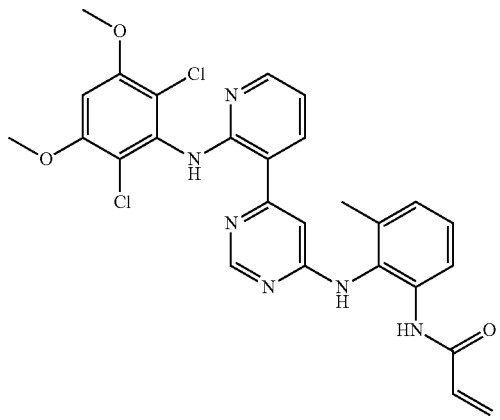

Table 2 below compares the properties of inventive compound 1 and control compound 5, which indicates that compound 1 exhibits superior properties in solubility, permeability, mouse plasma stability, mouse liver microsome stability, in vivo exposure, and bioavailability than control compound 5. The inventive compound 1 improves the FGFR4-selective inhibitory effect. More importantly, the plasma stability of the inventive compound is significantly improved. Also, control compound 5 has poor solubility in the solution of 5% DMSO and 95% of (20% HPBC in PBS). The inventive compound 1, on the other hand, exhibits a much-improved solubility which facilitates its administration.

TABLE 2

Comparison of the properties between inventive compound 1 and control compound 5.

| Compound | Compound 1 | Compound 5 |
|---|---|---|
| Molecular weight | 530.12 | 550.13 |
| s + LogP | 3.13 | 5.08 |
| s + LogD 7.4 | 3.12 | 5.08 |
| MDCK Permeability Papp, A-B ($1X10^{-6}$ cm/s) | 25.8 | 11.4 |
| Protein binding (%) | 92 | — |
| T_PSA $Å^2$ | 119.52 | 110.29 |
| $IC_{50}$ towards FGFR1 (nM) | 1280 | >30000 |
| $IC_{50}$ towards FGFR2 (nM) | 1870 | >30000 |
| $IC_{50}$ towards FGFR3 (nM) | 4440 | >30000 |
| $IC_{50}$ towards FGFR4 (nM) | 20 | 4.1 |
| Hepatocyte Clin Ms (mL/min/$10^6$ cells) (SE) | 43.63 ± 1.30 | 41.70 ± 1.73 |
| Ms Plasma Stability $t_{1/2}$ (min)(SE) | 1147.5 ± 347.0 | 221.2 ± 55.7 |
| CL (L/h/kg)|Vss (L/kg)| $t_{1/2}$ (h)|% F | 1.6|0.88|0.52|20.9 | 0.84|1.53|15(?)|8.0 |

Referring to FIGS. 2 and 3, the inventive compound 5 also exhibits an non-obvious improvement of pharmacokinetic data when administered into mice. Table 3 below summarizes the critical pharmacokinetic data from these experiments.

TABLE 3

Pharmacokinetic data of inventive compound 1 and control compound 5.

Figure 2A:
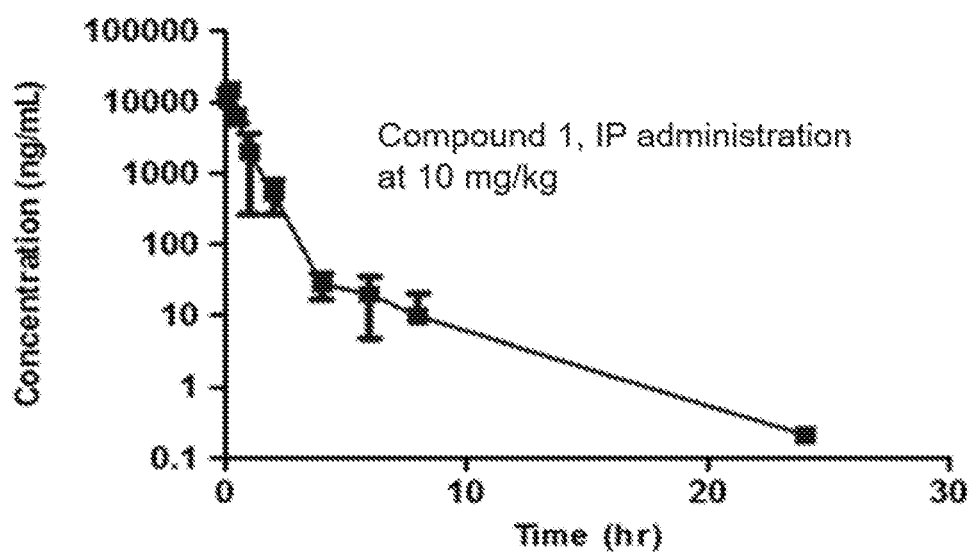
FIG. 2A is the pharmacokinetic data of compound 1 administered by intraperitoneal injection (IP) into mice at 10 mg/kg, according to some embodiments of the present disclosure.
Figure 2B:
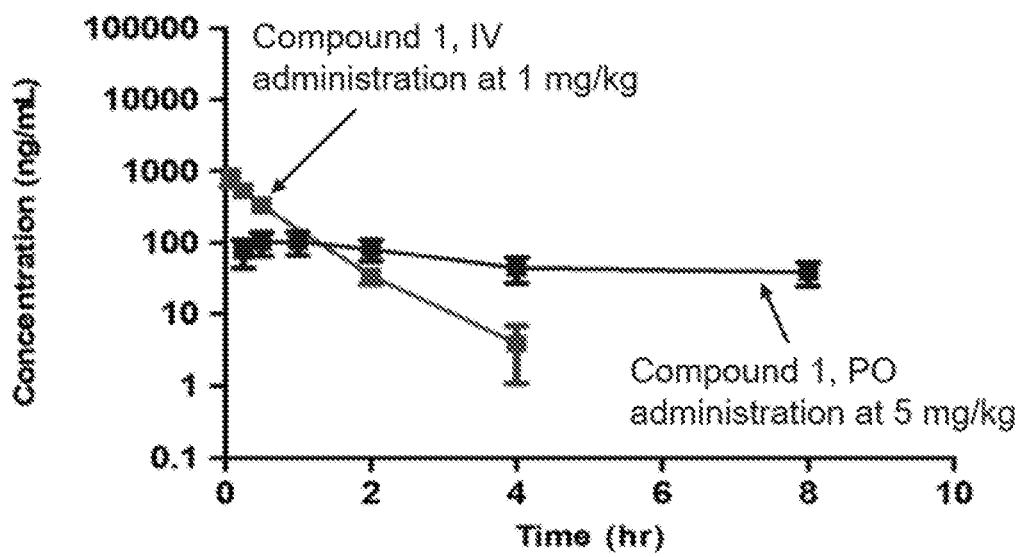
FIG. 2B is the pharmacokinetic data of compound 1 administered by intravenous injection (IV) into mice at 1 mg/kg and per os (PO) at 5 mg/kg, according to some embodiments of the present disclosure.
Figure 3A:
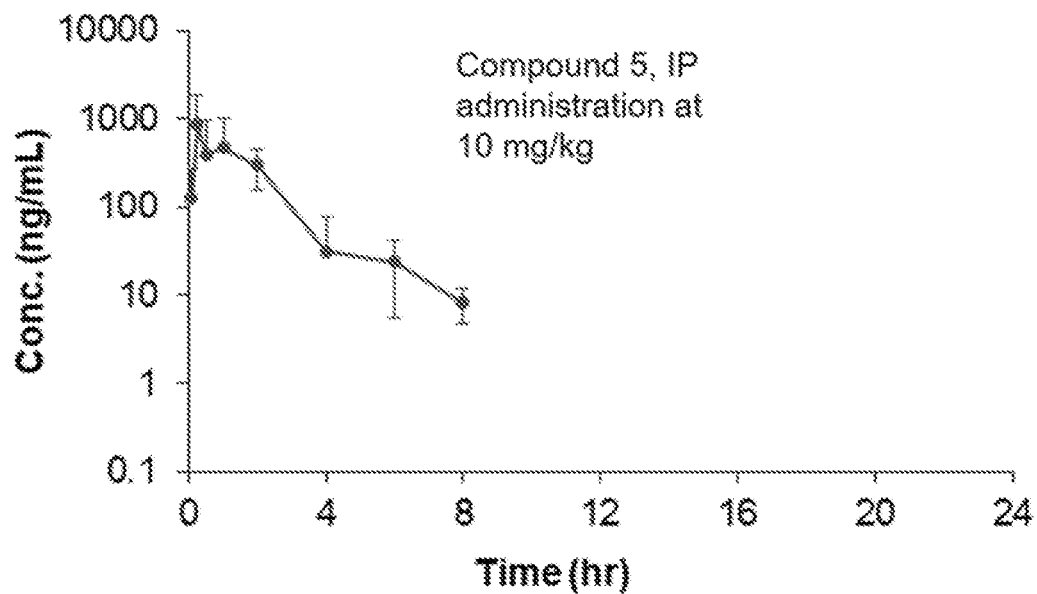
FIG. 3A is the mean plasma concentration time profile of compound 5 by IP administration in female CD-1 mice at 10 mg/kg, according to some embodiments of the present disclosure.
Figure 3B:
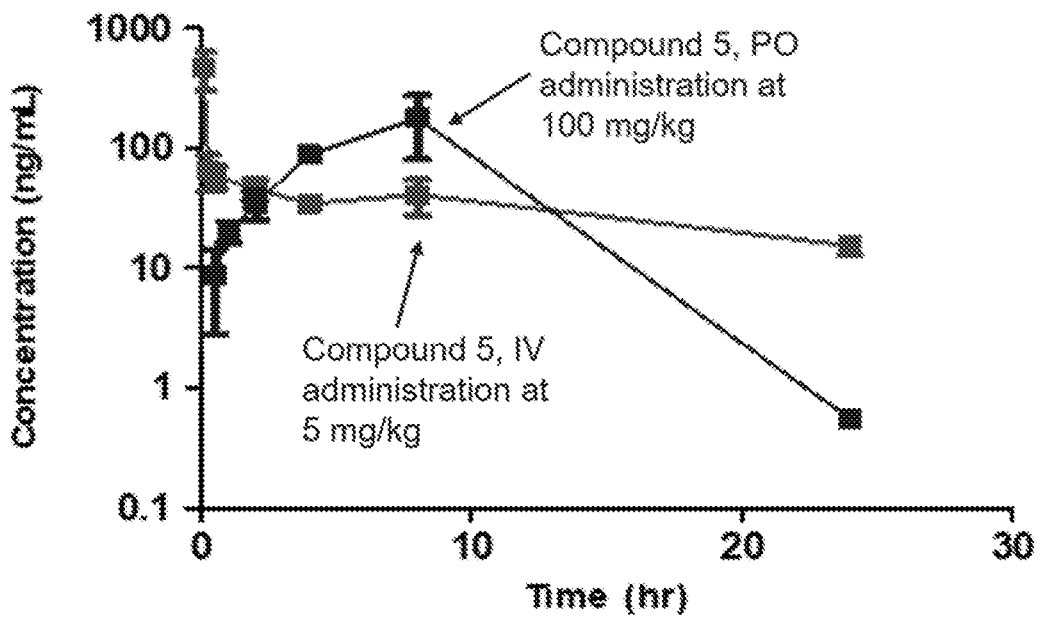
FIG. 3B is the pharmacokinetic data of compound 5 by IV administration at 5 mg/kg and PO administration at 100 mg/kg, according to some embodiments of the present disclosure.

| | Compound | | | | | |
|---|---|---|---|---|---|---|
| | Compound 1 | | | Compound 5 | | |
| Route | IP | IV | PO | IP | IV | PO |
| Dose (mg/kg) | 10 | 1 | 5 | 10 | 5 | 100 |
| FIGS. | FIG. 2A | FIG. 2B | FIG. 2B | FIG. 3A | FIG. 3B | FIG. 3B |
| $T_{max}$ (hr) | 0.25 | 0.083 | 3.17 | 0.25 | 0.083 | 6.67 |
| $C_{max}$ (ng/mL) | 14867 | 849 | 119 | 865 | 470 | 180 |
| $T_{1/2}$ (hr) | 2.81 | 0.522 | 2.73 | 1.23 | 15.1 | — |
| $MRT_{last}$ (hr) | 0.67 | 0.515 | 3.42 | 1.57 | 7.71 | 6.1 |
| $MRT_{inf}$ (hr) | 0.67 | 0.537 | 4.02 | 1.66 | 18.5 | — |
| $AUC_{last}$ (hr*ng/mL) | 9608 | 618 | 465 | 1270 | 896 | 1450 |
| $AUC_{inf}$ (hr*ng/mL) | 9609 | 621 | 648 | 1280 | 1240 | — |
| Cl (mL/hr/kg) | — | 1632 | — | — | 837 | 8.09 |
| Vss (mL/kg) | — | 876 | — | — | 15300 | — |
| F (%) | — | — | 20.9 | — | — | 8.09 |

TABLE 4

FGFR inhibition data of the disclosed compounds.

| Compound No. | Molecular Structure | FGFR1 Inhibition | FGFR2 Inhibition | FGFR3 Inhibition | FGFR4 inhibition |
|---|---|---|---|---|---|
| Compound 1 | 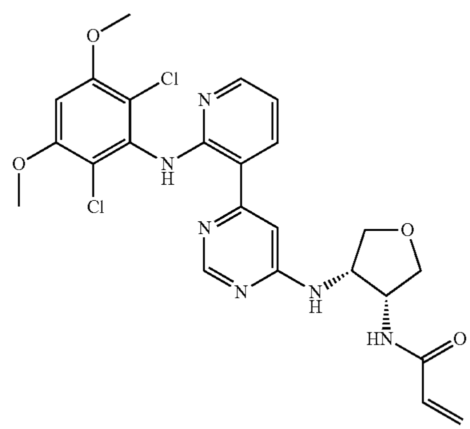 [SMILES: C=CC(=O)N[C@H]1COC[C@H]1Nc1cc(-c2cccnc2Nc2c(Cl)c(OC)cc(OC)c2Cl)ncn1] | — | — | — | ++ |
| Compound 2 | 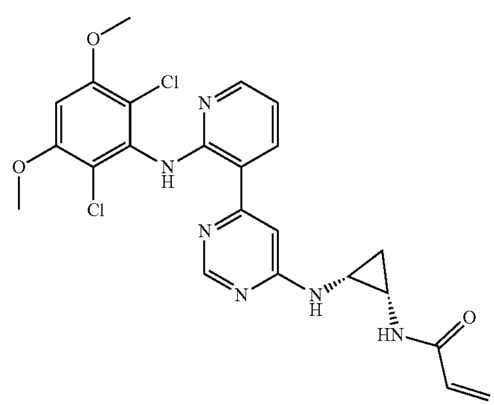 [SMILES: C=CC(=O)N[C@H]1C[C@H]1Nc1cc(-c2cccnc2Nc2c(Cl)c(OC)cc(OC)c2Cl)ncn1] | ++ | + | + | +++ |

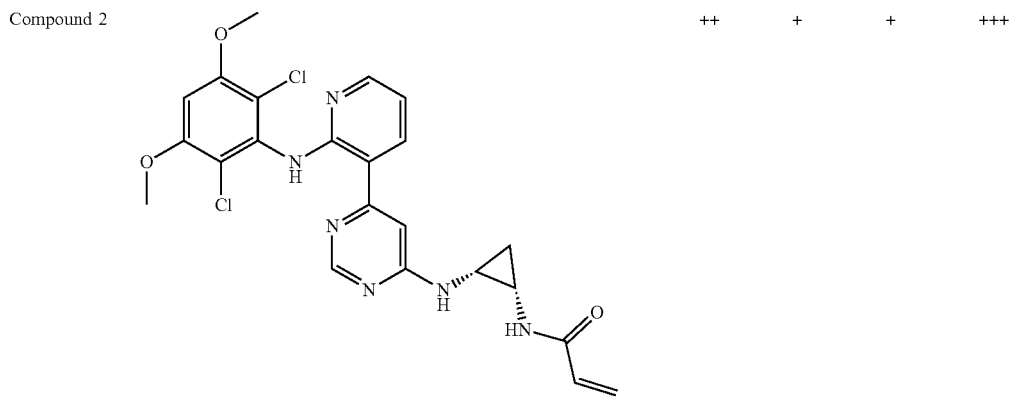

TABLE 4-continued
FGFR inhibition data of the disclosed compounds.
| Compound No. | Molecular Structure | FGFR1 Inhibition | FGFR2 Inhibition | FGFR3 Inhibition | FGFR4 inhibition |
|---|---|---|---|---|---|
| Compound 3 | 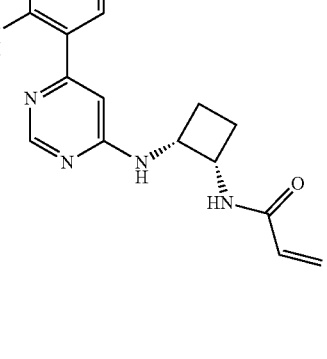 | ND | ND | ND | + |
| Compound 4 | 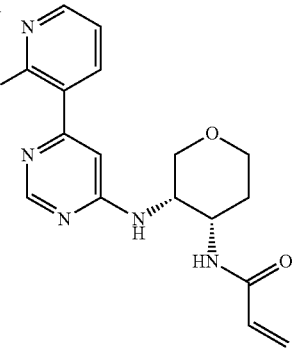 | ND | ND | ND | ++ |
| Compound 5 (Control) | 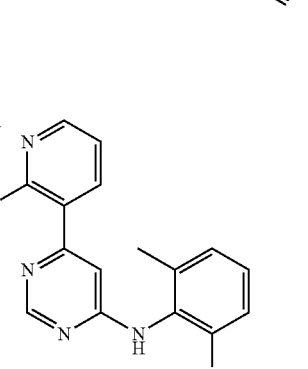 | — | — | — | +++ |

TABLE 4-continued

FGFR inhibition data of the disclosed compounds.

| Compound No. | Molecular Structure | FGFR1 Inhibition | FGFR2 Inhibition | FGFR3 Inhibition | FGFR4 inhibition |
|---|---|---|---|---|---|
| Compound 6 | 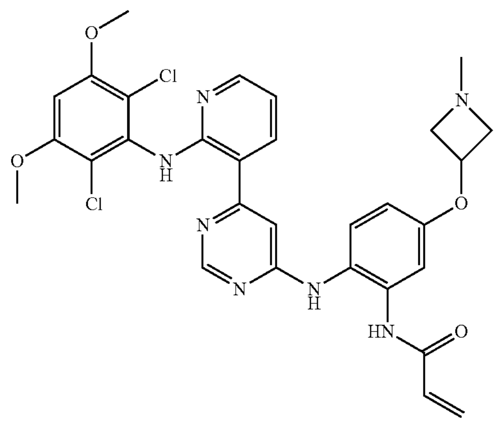 [SMILES: C=CC(=O)Nc1cc(OC2CN(C)C2)ccc1Nc1cc(-c2cccnc2Nc2c(Cl)c(OC)cc(OC)c2Cl)ncn1] | + | + | — | +++ |
| Compound 7 | 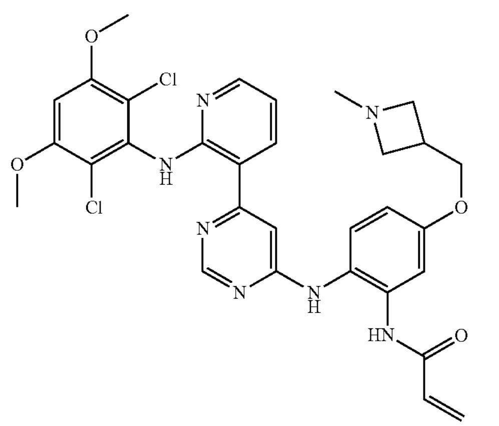 [SMILES: C=CC(=O)Nc1cc(OCC2CN(C)C2)ccc1Nc1cc(-c2cccnc2Nc2c(Cl)c(OC)cc(OC)c2Cl)ncn1] | + | + | — | +++ |
| Compound 8 | 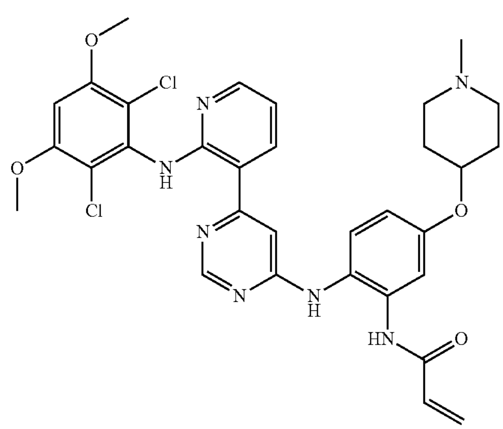 [SMILES: C=CC(=O)Nc1cc(OC2CCN(C)CC2)ccc1Nc1cc(-c2cccnc2Nc2c(Cl)c(OC)cc(OC)c2Cl)ncn1] | — | + | — | +++ |

TABLE 4-continued

FGFR inhibition data of the disclosed compounds.

| Compound No. | Molecular Structure | FGFR1 Inhibition | FGFR2 Inhibition | FGFR3 Inhibition | FGFR4 inhibition |
|---|---|---|---|---|---|
| Compound 9 | 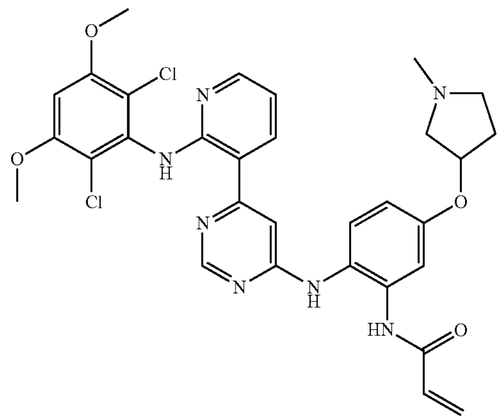 [SMILES: C=CC(=O)Nc1cc(OC2CCN(C)C2)ccc1Nc1cc(-c2cccnc2Nc2c(Cl)c(OC)cc(OC)c2Cl)ncn1] | + | + | — | +++ |
| Compound 10 | 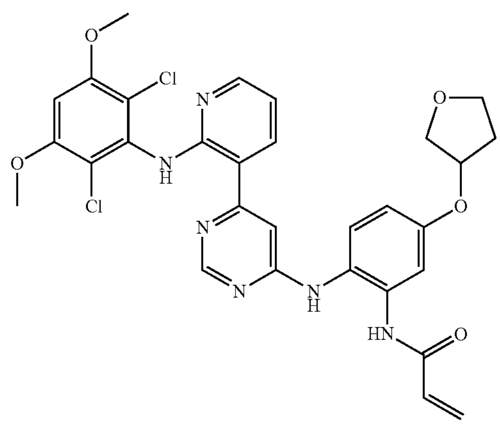 [SMILES: C=CC(=O)Nc1cc(OC2CCOC2)ccc1Nc1cc(-c2cccnc2Nc2c(Cl)c(OC)cc(OC)c2Cl)ncn1] | — | — | — | +++ |
| Compound 11 | 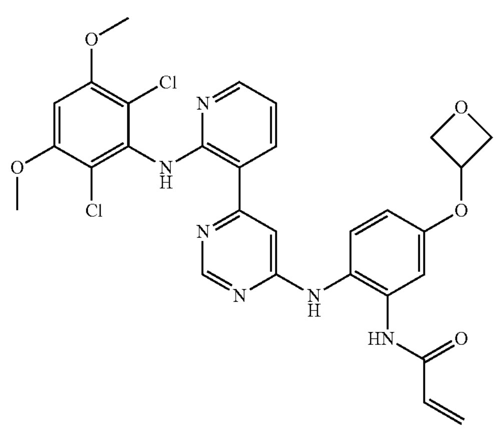 [SMILES: C=CC(=O)Nc1cc(OC2COC2)ccc1Nc1cc(-c2cccnc2Nc2c(Cl)c(OC)cc(OC)c2Cl)ncn1] | — | — | — | +++ |

TABLE 4-continued

FGFR inhibition data of the disclosed compounds.

| Compound No. | Molecular Structure | FGFR1 Inhibition | FGFR2 Inhibition | FGFR3 Inhibition | FGFR4 inhibition |
|---|---|---|---|---|---|
| Compound 12 | 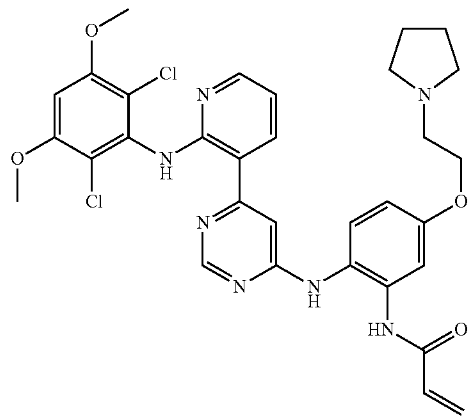 [SMILES: C=CC(=O)Nc1cc(OCCN2CCCC2)ccc1Nc1cc(-c2cccnc2Nc2c(Cl)c(OC)cc(OC)c2Cl)ncn1] | + | + | — | +++ |
| Compound 13 | 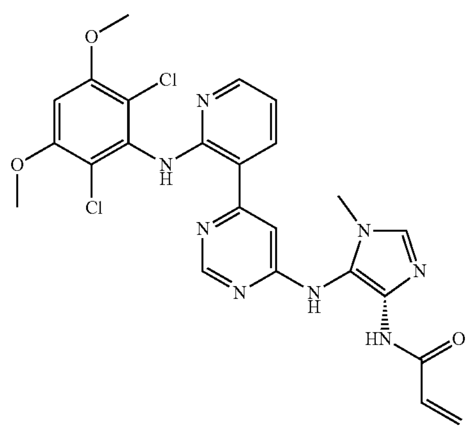 | ND | ND | ND | — |
| Compound 14 | 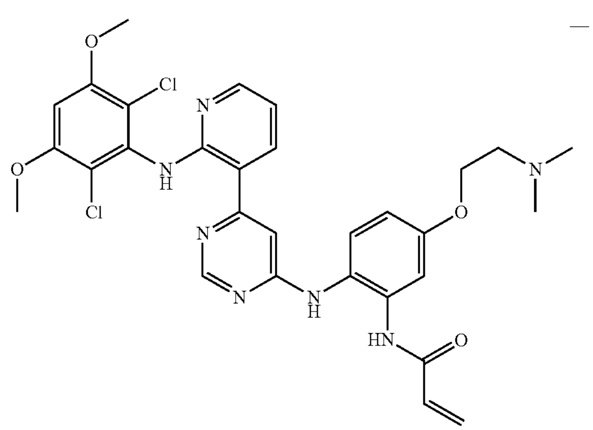 | — | — | — | +++ |

TABLE 4-continued

FGFR inhibition data of the disclosed compounds.

| Compound No. | Molecular Structure | FGFR1 Inhibition | FGFR2 Inhibition | FGFR3 Inhibition | FGFR4 inhibition |
|---|---|---|---|---|---|
| Compound 15 | 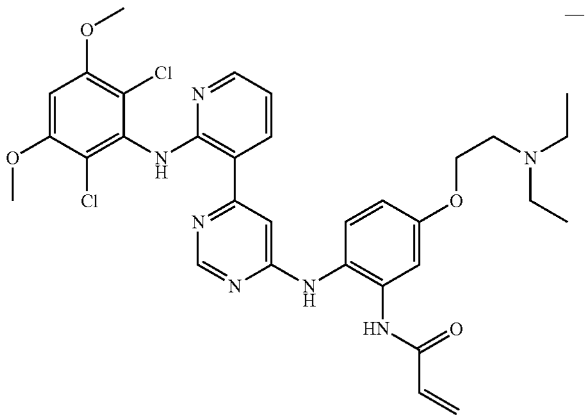 | — | — | — | +++ |
| Compound 16 | 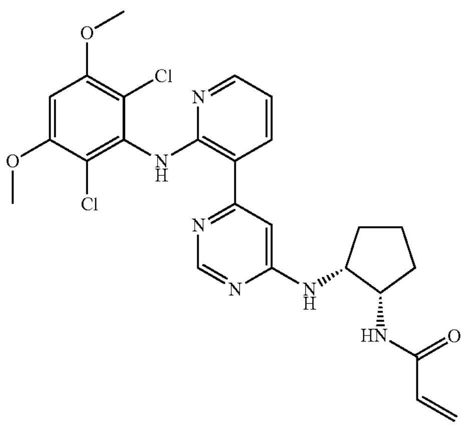 [SMILES: C=CC(=O)N[C@H]1CCC[C@H]1Nc1cc(-c2cccnc2Nc2c(Cl)c(OC)cc(OC)c2Cl)ncn1] | ND | ND | ND | + |

The evaluation standards of IC$_{50}$ values against the kinases in the table are shown below.
+++ below or equal to 10 nM
++ between 10 and 100 nM
+ between 100 and 1000 nM
— above or equal 1000 nM
ND Not determined The FGFR inhibition data of the disclosed compounds are shown in Table 4. Compound 5 is used as a control.

TABLE 5

FGFR sequences.

| SEQ ID NO: 1 | FGFR1 isoform 1 Nucleic acid sequence | AGATGCAGGGGCGCAAACGCCAAAGGAGACCAGGCTGTAGGAAGAGAAGGGCAGAGC<br>GCCGGACAGCTCGGCCCGCTCCCCGTCCTTTGGGGCCGCGGCTGGGGAACTACAAGG<br>CCCAGCAGGCAGCTGCAGGGGCGGAGGCGGAGGAGGGACCAGCGCGGGTGGGAGTG<br>AGAGAGCGAGCCCTCGCGCCCCGCCGGCGCATAGCGCTCGGAGCGCTCTTGCGGCCA<br>CAGGCGCGGCGTCCTCGGCGGCGGGCGGCAGCTAGCGGGAGCCGGGACGCCGGTGCA<br>GCCGCAGCGCGCGGAGGAACCCGGGTGTGCCGGGAGCTGGGCGGCCACGTCCGGACG<br>GGACCGAGACCCCTCGTAGCGCATTGCGGCGACCTCGCCTTCCCCGGCCGCGAGCGC<br>GCCGCTGCTTGAAAAGCCGCGGAACCCAAGGACTTTTCTCCGGTCCGAGCTCGGGGC<br>GCCCCGCAGGGCGCACGGTACCCGTGCTGCAGTCGGGCACGCCGCGGCGCCGGGGCC<br>TCCGCAGGGCGATGGAGCCCGGTCTGCAAGGAAAGTGAGGCGCCGCCGCTGCGTTCT<br>GGAGGAGGGGGCACAAGGTCTGGAGACCCCGGGTGGCGGACGGGAGCCCTCCCCCC<br>GCCCCGCCTCCGGGGCACCAGCTCCGGCTCCATTGTTCCCGCCCGGGCTGGAGGCGC<br>CGAGCACCGAGCGCCGCCGGGAGTCGAGCGCCGGCCGCGGAGCTCTTGCGACCCCGC<br>CAGGACCCGAACAGAGCCCGGGGGCGGCGGGCCGGAGCCGGGGACGCGGGCACACGC<br>CCGCTCGCACAAGCCACGGCGGACTCTCCCGAGGCGGAACCTCCACGCCGAGCGAGG<br>GTCAGTTTGAAAAGGAGGATCGAGCTCACTGTGGAGTATCCATGGAGATGTGGAGCC<br>TTGTCACCAACCTCTAACTGCAGAACTGGGATGTGGAGCTGGAAGTGCCTCCTCTTC<br>TGGGCTGTGCTGGTCACAGCCACACTCTGCACCGCTAGGCCGTCCCCGACCTTGCCT |

TABLE 5-continued

FGFR sequences.

```
GAACAAGCCCAGCCCTGGGGAGCCCCTGTGGAAGTGGAGTCCTTCCTGGTCCACCCC
GGTGACCTGCTGCAGCTTCGCTGTCGGCTGCGGGACGATGTGCAGAGCATCAACTGG
CTGCGGGACGGGGTGCAGCTGGCGGAAAGCAACCGCACCCGCATCACAGGGGAGGAG
GTGGAGGTGCAGGACTCCGTGCCCGCAGACTCCGGCCTCTATGCTTGCGTAACCAGC
AGCCCCTCGGGCAGTGACACCACCTACTTCTCCGTCAATGTTTCAGATGCTCTCCCC
TCCTCGGAGGATGATGATGATGATGATGACTCCTCTTCAGAGGAGAAAGAAACAGAT
AACACCAAACCAAACCGTATGCCCGTAGCTCCATATTGGACATCCCCAGAAAAGATG
GAAAAGAAATTGCATGCAGTGCCGGCTGCCAAGACAGTGAAGTTCAAATGCCCTTCC
AGTGGGACCCCAAACCCCACACTGCGCTGGTTGAAAAATGGCAAAGAATTCAAACCT
GACCCACAGAATTGGAGGCTACAAGGTCCGTTATGCCACCTGGAGCATCATAATGGAC
TCTGTGGTGCCCTCTGACAAGGGCAACTACACCTGCATTGTGGAGAATGAGTACGGC
AGCATCAACCACACATACCAGCTGGATGTCGTGGAGCGGTCCCCTCACCGGCCCATC
CTGCAAGCAGGGTTGCCCGCCAACAAAACAGTGGCCCTGGGTAGCAACGTGGAGTTC
ATGTGTAAGGTGTACAGTGACCCGCAGCCGCACATCCAGTGGCTAAAGCACATCGAG
GTGAATGGGAGCAAGATTGGCCCAGACAACCTGCCTTATGTCCAGATCTTGAAGACT
GCTGGAGTTAATACCACCGACAAAGAGATGGAGGTGCTTCACTTAAGAAATGTCTCC
TTTGAGGACGCAGGGGAGTATACGTGCTTGGCGGGTAACTCTATCGGACTCTCCCAT
CACTCTGCATGGTTGACCGTTCTGGAAGCCCTGGAAGAGAGGCCGGCAGTGATGACC
TCGCCCCTGTACCTGGAGATCATCATCTATTGCACAGGGGCCTTCCTCATCTCCTGC
ATGGTGGGGTCGGTCATCGTCTACAAGATGAAGAGTGGTACCAAGAAGAGTGACTTC
CACAGCCAGATGGCTGTGCACAAGCTGGCCAAGAGCATCCCTCTGCGCAGACAGGTA
ACAGTGTCTGCTGACTCCAGTGCATCCATGAACTCTGGGGTTCTTCTGGTTCGGCCA
TCACGGCTCTCCTCCAGTGGGACTCCCATGCTAGCAGGGGTCTCTGAGTATGAGCTT
CCCGAAGACCCTCGCTGGGAGCTGCCTCGGGACAGACTGGTCTTAGGCAAACCCCTG
GGAGAGGGCTGCTTTGGGCAGGTGGTGTTGGCAGAGGCTATCGGGCTGGACAAGGAC
AAACCCAACCGTGTGACCAAAGTGGCTGTGAAGATGTTGAAGTCGGACGCAACAGAG
AAAGACTTGTCAGACCTGATCTCAGAAATGGAGATGATGAAGATGATCGGGAAGCAT
AAGAATATCATCAACCTGCTGGGGGCCTGCACGCAGGATGGTCCCTTGTATGTCATC
GTGGAGTATGCCTCCAAGGGCAACCTGCGGGAGTACCTGCAGGCCCGGAGGCCCCCA
GGGCTGGAATACTGCTACAACCCCAGCCACAACCCAGAGGAGCAGCTCTCCTCCAAG
GACCTGGTGTCCTGCGCCTACCAGGTGGCCCGAGGCATGGAGTATCTGGCCTCCAAG
AAGTGCATACACCGAGACCTGGCAGCCAGGAATGTCCTGGTGACAGAGGACAATGTG
ATGAAGATAGCAGACTTTGGCCTCGCACGGGACATTCACCACATCGACTACTATAAA
AAGACAACCAACGGCCGACTGCCTGTGAAGTGGATGGCACCCGAGGCATTATTTGAC
CGGATCTACACCCACCAGAGTGATGTGTGGTCTTTCGGGGTGCTCCTGTGGGAGATC
TTCACTCTGGGCGGCTCCCCATACCCCGGTGTGCCTGTGGAGGAACTTTTCAAGCTG
CTGAAGGAGGGTCACCGCATGGACAAGCCCAGTAACTGCACCAACGAGCTGTACATG
ATGATGCGGGACTGCTGGCATGCAGTGCCCTCACAGAGACCCACCTTCAAGCAGCTG
GTGGAAGACCTGGACCGCATCGTGGCCTTGACCTCCAACCAGGAGTACCTGGACCTG
TCCATGCCCCTGGACCAGTACTCCCCCAGCTTTCCCGACACCCGGAGCTCTACGTGC
TCCTCAGGGGAGGATTCCGTCTTCTCTCATGAGCCGCTGCCCGAGGAGCCCTGCCTG
CCCCGACACCCAGCCCAGCTTGCCAATGGCGGACTCAAACGCCGCTGACTGCCACCC
ACACGCCCTCCCCAGACTCCACCGTCAGCTGTAACCCTCACCCACAGCCCCTGCTGG
GCCCACCACCTGTCCGTCCCTGTCCCCTTTCCTGCTGGCAGGAGCCGGCTGCCTACC
AGGGGCCTTCCTGTGTGGCCTGCCTTCACCCCACTCAGCTCACCTCTCCCTCCACCT
CCTCTCCACCTGCTGGTGAGAGGTGCAAAGAGGCAGATCTTTGCTGCCAGCCACTTC
ATCCCCTCCCAGATGTTGGACCAACACCCCTCCCTGCCACCAGGCACTGCCTGGAGG
GCAGGGAGTGGGAGCCAATGAACAGGCATGCAAGTGAGAGCTTCCTGAGCTTTCTCC
TGTCCGGTTTGGTCTGTTTTGCCTTCACCCATAAGCCCCTCGCACTCTGGTGGCAGGT
GCCTTGTCCTCAGGGCTACAGCAGTAGGGAGGTCAGTGCTTCGTGCCTCGATTGAAG
GTGACCTCTGCCCCAGATAGGTGGTGCCAGTGGCTTATTAATTCCGATACTAGTTTG
CTTTGCTGACCAAATGCCTGGTACCAGAGGATGGTGAGGCGAAGGCCAGGTTGGGGG
CAGTGTTGTGGCCCTGGGGCCCAGCCCCAAACTGGGGGCTCTGTATATAGCTATGAA
GAAAACACAAAGTGTATAAATCTGAGTATATATTTACATGTCTTTTTAAAAGGGTCG
TTACCAGAGATTTACCCATCGGGTAAGATGCTCCTGGTGGCTGGGAGGCATCAGTTG
CTATATATTAAAAACAAAAAAGAAAAAAAAGGAAAATGTTTTTAAAAAGGTCATATA
TTTTTTGCTACTTTTGCTGTTTTATTTTTTTAAATTATGTTCTAAACCTATTTTCAG
TTTAGGTCCCTCAATAAAAATTGCTGCTGCTTCATTTATCTATGGGCTGTATGAAAA
GGGTGGGAATGTCCACTGGAAAGAAGGGACACCCACGGGCCCTGGGGCTAGGTCTGT
CCCGAGGGCACCGCATGCTCCCGGCGCAGGTTCTTGTAACCTCTTCTTCCTAGGTC
CTGCACCCAGACCTCACGACGCACCTCCTGCCTCTCCGCTGCTTTTGGAAAGTCAGA
AAAAGAAGATGTCTGCTTCGAGGGCAGGAACCCCATCCATGCAGTAGAGGCGCTGGG
CAGAGAGTCAAGGCCCAGCAGCCATCGACCATGGATGGTTCCTCCAAGGAAACCGG
TGGGGTTGGGCTGGGAGGGGGCACCTACCTAGGAATAGCCACGGGGTAGAGCTACA
GTGATTAAGAGGAAAGCAAGGGCGCGGTTGCTCACGCCTGTAATCCCAGCACTTTGG
GACACCGAGGTGGGCAGATCACTTCAGGTCAGGAGTTTGAGACCAGCCTGGCCAACT
TAGTGAAACCCCATCTCTACTAAAAATGCAAAAATTATCCAGGCATGGTGGCACACG
CCTGTAATCCCAGCTCCACAGGAGGCTGAGGCAGAATCCCTTGAAGCTGGGAGGCGG
AGGTTGCAGTGAGCCGAGATTGCGCCATTGCACTCCAGCCTGGGCAACAGAGAAAAC
AAAAAGGAAAACAAATGATGAAGGTCTGCAGAAACTGAAACCCAGACATGTGTCTGC
CCCCTCTATGTGGGCATGGTTTTGCCAGTGCTTCTAAGTGCAGGAGAACATGTCACC
TGAGGCTAGTTTTGCATTCAGGTCCCTGGCTTCGTTTCTTGTTGGTATGCCTCCCCA
GATCGTCCTTCCTGTATCCATGTGACCAGACTGTATTTGTTGGGACTGTCGCAGATC
TTGGCTTCTTACAGTTCTTCCTGTCCAAACTCCATCCTGTCCCTCAGGAACGGGGGG
AAAATTCTCCGAATGTTTTGGTTTTTTGGCTGCTTGGAATTTACTTCTGCCACCTG
CTGGTCATCACTGTCCTCACTAAGTGGATTCTGGCTCCCCCGTACCTCATGGCTCAA
ACTACCACTCCTCAGTCGCTATATTAAAGCTTATATTTTGCTGGATTACTGCTAAAT
ACAAAAGAAAGTTCAATATGTTTTCATTTCTGTAGGGAAAATGGGATTGCTGCTTTA
```

TABLE 5-continued

FGFR sequences.

|  |  |  |
|---|---|---|
|  |  | AATTTCTGAGCTAGGGATTTTTTGGCAGCTGCAGTGTTGGCGACTATTGTAAAATTC<br>TCTTTGTTTCTCTCTGTAAATAGCACCTGCTAACATTACAATTTGTATTTATGTTTA<br>AAGAAGGCATCATTTGGTGAACAGAACTAGGGAAATGAATTTTTAGCTCTTAAAAGCA<br>TTTGCTTTGAGACCGCACAGGAGTGTCTTTCCTTGTAAAACAGTGATGATAATTTCT<br>GCCTTGGCCCTACCTTGAAGCAATGTTGTGTGAAGGGATGAAGAATCTAAAAGTCTT<br>CATAAGTCCTTGGGAGAGGTGCTAGAAAAATATAAGGCACTATCATAATTACAGTGA<br>TGTCCTTGCTGTTACTACTCAAATCACCCACAAATTTCCCCAAAGACTGCGCTAGCT<br>GTCAAATAAAAGACAGTGAAATTGACCTG |
| SEQ ID<br>NO: 2 | FGFR1<br>isoform 1<br>Amino acid<br>sequence | MWSWKCLLFWAVLVTATLCTARPSPTLPEQAQPWGAPVEVESFLVHPGDLLQLRCRL<br>RDDVQSINWLRDGVQLAESNRTRITGEEVEVQDSVPADSGLYACVTSSPSGSDTTYF<br>SVNVSDALPSSEDDDDDDDSSSEEKETDNTKPNRMPVAPYWTSPEKMEKKLHAVPAA<br>KTVKFKCPSSGTPNPTLRWLKNGKEFKPDHRIGGYKVRYATWSIIMDSVVPSDKGNY<br>TCIVENEYGSINHTYQLDVVERSPHRPILQAGLPANKTVALGSNVEFMCKVYSDPQP<br>HIQWLKHIEVNGSKIGPDNLPYVQILKTAGVNTTDKEMEVLHLRNVSFEDAGEYTCL<br>AGNSIGLSHHSAWLTVLEALEERPAVMTSPLYLEIIIYCTGAFLISCMVGSVIVYKM<br>KSGTKKSDPHSQMAVHKLAKSIPLRRQVTVSADSSASMNSGVLLVRPSRLSSSGTPM<br>LAGVSEYELPEDPRWELPRDRLVLGKPLGEGCFGQVVLAEAIGLDKDKPNRVTKVAV<br>KMLKSDATEKDLSDLISEMEMMKMIGKHKNIINLLGACTQDGPLYVIVEYASKGNLR<br>EYLQARRPPGLEYCYNPSHNPEEQLSSKDLVSCAYQVARGMEYLASKKCIHRDLAAR<br>NVLVTEDNVMKIADFGLARDIHHIDYYKKTTNGRLPVKWMAPEALFDRIYTHQSDVW<br>SFGVLLWEIFTLGGSPYPGVPVEELFKLLKEGHRMDKPSNCTNELYMMMRDCWHAVP<br>SQRPTFKQLVEDLDRIVALTSNQEYLDLSMPLDQYSPSFPDTRSSTCSSGEDSVFSH<br>EPLPEEPCLPRHPAQLANGGLKRR |
| SEQ ID<br>NO: 3 | FGFR1<br>isoform 2<br>Nucleic acid<br>sequence | GCCGGCGCATAGCGCTCGGAGCGCTCTTGCGGCCACAGGCGCGGCGTCCTCGGCGGC<br>GGGCGGCAGCTAGCGGGAGCCGGGACGCCGGTGCAGCCGCAGCGCGCGGAGGAACCC<br>GGGTGTGCCGGGAGCTGGGCGGCCACGTCCGGACGGGACCGAGACCCCTCGTAGCGC<br>ATTGCGGCGACCTCGCCTTCCCCGGCCGCGAGCGCGCCGCTGCTTGAAAAGCCGCGG<br>AACCCAAGGACTTTTCTCCGGTCCGAGCTCGGGGCGCCCCGCAGGGCGCACGGTACC<br>CGTGCTGCAGTCGGGCACGCGCGGCGCCGGGGCCTCCGCAGGGCGATGGAGCCCGG<br>TCTGCAAGGAAAGTGAGGCGCCGCCGCTGCGTTCTGGAGGAGGGGGGCACAAGGTCT<br>GGAGACCCCGGGTGGCGGACGGGAGCCCTCCCCCCGCCCCGCCTCCGGGGCACCAGC<br>TCCCGGCTCCATTGTTCCCGCCCGGGCTGGAGGCGCCGAGCACCGAGCGCCGCGGGA<br>GTCGAGCGCCGGCCGCGGAGCTCTTGCGACCCCGCCAGGACCCGAACAGAGCCCGGG<br>GGCGGCGGGCCGGAGCCGGGACGCGGGACACGCCCGCTCGCACAAGCCACGGCGG<br>ACTCTCCCGAGGCGGAACCTCCACGCCGAGCGAGGGTCAGTTTGAAAAGGAGGATCG<br>AGCTCACTGTGGAGTATCCATGGAGATGTGGAGCCTTGTCACCAACCTCTAACTGCA<br>GAACTGGGATGTGGAGCTGGAAGTGCCTCCTCTTCTGGGCTGTGCTGGTCACAGCCA<br>CACTCTGCACCGCTAGGCCGTCCCCGACCTTGCCTGAACAAGCCCAGCCCTGGGGAG<br>CCCCTGTGGAAGTGGAGTCCTTCCTGGTCCACCCCGGTGACCTGCTGCAGCTTCGCT<br>GTCGGCTGCGGGACGATGTGCAGAGCATCAACTGGCTGCGGGACGGGGTGCAGCTGG<br>CGGAAAGCAACCGCACCCGCATCACAGGGGAGGAGGTGGAGGTGCAGGACTCCGTGC<br>CCGCAGACTCCGGCCTCTATGCTTGCGTAACCAGCAGCCCCTCGGGCAGTGACACCA<br>CCTACTTCTCCGTCAATGTTTCAGATGCTCTCCCCTCCTCGGAGGATGATGATGATG<br>ATGATGACTCCTCTTCAGAGGAGAAAGAAACAGATAACACCAAACCAAACCCCGTAG<br>CTCCATATTGGACATCCCCAGAAAAGATGGAAAAGAAATTGCATGCAGTGCCGGCTG<br>CCAAGACAGTGAAGTTCAAATGCCCTTCCAGTGGGACCCCAAACCCCACACTGCGCT<br>GGTTGAAAAATGGCAAAGAATTCAAACCTGACCACAGAATTGGAGGCTACAAGGTCC<br>GTTATGCCACCTGGAGCATCATAATGGACTCTGTGGTGCCCTCTGACAAGGGCAACT<br>ACACCTGCATTGTGGAGAATGAGTACGGCAGCATCAACCACACATACCAGCTGGATG<br>TCGTGGAGCGGTCCCCTCACCGGCCCATCCTGCAAGCAGGGTTGCCCGCCAACAAAA<br>CAGTGGCCCTGGGTAGCAACGTGGAGTTCATGTGTAAGGTGTACAGTGACCCGCAGC<br>CGCACATCCAGTGGCTAAAGCACATCGAGGTGAATGGGAGCAAGATTGGCCCAGACA<br>ACCTGCCTTATGTCCAGATCTTGAAGACTGCTGGAGTTAATACCACCGACAAAGAGA<br>TGGAGGTGCTTCACTTAAGAAATGTCTCCTTTGAGGACGCAGGGGAGTATACGTGCT<br>TGGCGGGTAACTCTATCGGACTCTCCCATCACTCTGCATGGTTGACCGTTCTGGAAG<br>CCCTGGAAGAGAGGCCGGCAGTGATGACCTCGCCCCTGTACCTGGAGATCATCATCT<br>ATTGCACAGGGGCCTTCCTCATCTCCTGCATGGTGGGTCGGTCATCGTCTACAAGA<br>TGAAGAGTGGTACCAAGAAGAGTGACTTCCACAGCCAGATGGCTGTGCACAAGCTGG<br>CCAAGAGCATCCCTCTGCGCAGACAGGTAACAGTGTCTGCTGACTCCAGTGCATCCA<br>TGAACTCTGGGGTTCTTCTGGTTCGGCCATCACGGCTCTCCTCCAGTGGGACTCCCA<br>TGCTAGCAGGGGTCTCTGAGTATGAGCTTCCCGAAGACCCTCGCTGGGAGCTGCCTC<br>GGGACAGACTGGTCTTAGGCAAACCCCTGGGAGAGGGCTGCTTTGGGCAGGTGGTGT<br>TGGCAGAGGCTATCGGGCTGGACAAGGACAAACCCAACCGTGTGACCAAAGTGGCTG<br>TGAAGATGTTGAAGTCGGACGCAACAGAGAAAGACTTGTCAGACCTGATCTCAGAAA<br>TGGAGATGATGAAGATGATCGGGAAGCATAAGAATATCATCAACCTGCTGGGGGCCT<br>GCACGCAGGATGGTCCCTTGTATGTCATCGTGGAGTATGCCTCCAAGGGCAACCTGC<br>GGGAGTACCTGCAGGCCCGGAGGCCCCCAGGGCTGGAATACTGCTACAACCCCAGCC<br>ACAACCCAGAGGAGCAGCTCTCCTCCAAGGACCTGGTGTCCTGCGCCTACCAGGTGG<br>CCCGAGGCATGGAGTATCTGGCCTCCAAGAAGTGCATACACCGAGACCTGGCAGCCA<br>GGAATGTCCTGGTGACAGAGGACAATGTGATGAAGATAGCAGACTTTGGCCTCGCAC<br>GGGACATTCACCACATCGACTACTATAAAAAGACAACCAACGGCCGACTGCCTGTGA<br>AGTGGATGGCACCCGAGGCATTATTTGACCGGATCTACACCCACCAGAGTGATGTGT<br>GGTCTTTCGGGGTGCTCCTGTGGGAGATCTTCACTCTGGGCGGCTCCCCATACCCCG<br>GTGTGCCTGTGGAGGAACTTTTCAAGCTGCTGAAGGAGGGTCACCGCATGGACAAGC<br>CCAGTAACTGCACCAACGAGCTGTACATGATGATGCGGGACTGCTGGCATGCAGTGC<br>CCTCACAGAGACCCACCTTCAAGCAGCTGGTGGAAGACCTGGACCGCATCGTGGCCT |

TABLE 5-continued

FGFR sequences.

|  |  |  |
|---|---|---|
|  |  | TGACCTCCAACCAGGAGTACCTGGACCTGTCCATGCCCCTGGACCAGTACTCCCCCA<br>GCTTTCCCGACACCCGGAGCTCTACGTGCTCCTCAGGGGAGGATTCCGTCTTCTCTC<br>ATGAGCCGCTGCCCGAGGAGCCCTGCCTGCCCCGACACCCAGCCCAGCTTGCCAATG<br>GCGGACTCAAACGCCGCTGACTGCCACCCACACGCCCTCCCCAGACTCCACCGTCAG<br>CTGTAACCCTCACCCACAGCCCCTGCTGGGCCCACCACCTGTCCGTCCCTGTCCCCT<br>TTCCTGCTGGCAGGAGCCGGCTGCCTACCAGGGGCCTTCCTGTGTGGCCTGCCTTCA<br>CCCCACTCAGCTCACCTCTCCCTCCACCTCCTCTCCACCTGCTGGTGAGAGGTGCAA<br>AGAGGCAGATCTTTGCTGCCAGCCACTTCATCCCCTCCCAGATGTTGGACCAACACC<br>CCTCCCTGCCACCAGGCACTGCCTGGAGGGCAGGGAGTGGGAGCCAATGAACAGGCA<br>TGCAAGTGAGAGCTTCCTGAGCTTTCTCCTGTCGGTTTGGTCTGTTTTGCCTTCACC<br>CATAAGCCCCTCGCACTCTGGTGGCAGGTGCCTTGTCCTCAGGGCTACAGCAGTAGG<br>GAGGTCAGTGCTTCGTGCCTCGATTGAAGGTGACCTCTGCCCAGATAGGTGGTGCC<br>AGTGGCTTATTAATTCCGATACTAGTTTGCTTTGCTGACCAAATGCCTGGTACCAGA<br>GGATGGTGAGGCGAAGGCCAGGTTGGGGGCAGTGTTGTGGCCCTGGGGCCCAGCCCC<br>AAACTGGGGGCTCTGTATATAGCTATGAAGAAAACACAAAGTGTATAAATCTGAGTA<br>TATATTTACATGTCTTTTTAAAAGGGTCGTTACCAGAGATTTACCCATCGGGTAAGA<br>TGCTCCTGGTGGCTGGGAGGCATCAGTTGCTATATATTAAAAACAAAAAAGAAAAAA<br>AAGGAAAATGTTTTTAAAAAGGTCATATATTTTTTGCTACTTTTGCTGTTTTATTTT<br>TTTAAATTATGTTCTAAACCTATTTTCAGTTTAGGTCCCTCAATAAAAATTGCTGCT<br>GCTTCATTTATCTATGGGCTGTATGAAAAGGGTGGGAATGTCCACTGGAAAGAAGGG<br>ACACCCACGGGCCCTGGGCTAGGTCTGTCCCGAGGGCACCGCATGCTCCCGGCGCA<br>GGTTCCTTGTAACCTCTTCTTCCTAGGTCCTGCACCCAGACCTCACGACGCACCTCC<br>TGCCTCTCCGCTGCTTTTGGAAAGTCAGAAAAAGAAGATGTCTGCTTCGAGGGCAGG<br>AACCCCATCCATGCAGTAGAGGCGCTGGGCAGAGAGTCAAGGCCCAGCAGCCATCGA<br>CCATGGATGGTTTCCTCCAAGGAAACCGGTGGGGTTGGGCTGGGGAGGGGCACCTA<br>CCTAGGAATAGCCACGGGGTAGAGCTACAGTGATTAAGAGGAAAGCAAGGGCGCGGT<br>TGCTCACGCCTGTAATCCCAGCACTTTGGGACACCGAGGTGGGCAGATCACTTCAGG<br>TCAGGAGTTTGAGACCAGCCTGGCCAACTTAGTGAAACCCCATCTCTACTAAAAATG<br>CAAAAATTATCCAGGCATGGTGGCACACGCCTGTAATCCCAGCTCCACAGGAGGCTG<br>AGGCAGAATCCCTTGAAGCTGGGAGGCGGAGGTTGCAGTGAGCCGAGATTGCGCCAT<br>TGCACTCCAGCCTGGGCAACAGAGAAAACAAAAGGAAAACAAATGATGAAGGTCTG<br>CAGAAACTGAAACCCAGACATGTGTCTGCCCCCTCTATGTGGGCATGGTTTTGCCAG<br>TGCTTCTAAGTGCAGGAGAACATGTCACCTGAGGCTAGTTTTGCATTCAGGTCCCTG<br>GCTTCGTTTCTTGTTGGTATGCCTCCCCAGATCGTCCTTCCTGTATCCATGTGACCA<br>GACTGTATTTGTTGGGACTGTCCAGATCTTGGCTTCTTACAGTTCTTCCTGTCCAA<br>ACTCCATCCTGTCCCTCAGGAACGGGGGGAAAATTCTCCGAATGTTTTTGGTTTTTT<br>GGCTGCTTGGAATTTACTTCTGCCACCTGCTGGTCATCACTGTCCTCACTAAGTGGA<br>TTCTGGCTCCCCCGTACCTCATGGCTCAAACTACCACTCCTCAGTCGCTATATTAAA<br>GCTTATATTTTGCTGGATTACTGCTAAATACAAAAGAAAGTTCAATATGTTTTCATT<br>TCTGTAGGGAAAATGGGATTGCTGCTTTAAATTTCTGAGCTAGGGATTTTTTGGCAG<br>CTGCAGTGTTGGCGACTATTGTAAAATTCTCTTTGTTTCTCTCTGTAAATAGCACCT<br>GCTAACATTACAATTTGTATTTATGTTTAAAGAAGGCATCATTTGGTGAACAGAACT<br>AGGAAATGAATTTTTAGCTCTTAAAAGCATTTGCTTTGAGACCGCACAGGAGTGTCT<br>TTCCTTGTAAAACAGTGATGATAATTTCTGCCTTGGCCCTACCTTGAAGCAATGTTG<br>TGTGAAGGGATGAAGAATCTAAAAGTCTTCATAAGTCCTTGGGAGAGGTGCTAGAAA<br>AATATAAGGCACTATCATAATTACAGTGATGTCCTTGCTGTTACTACTCAAATCACC<br>CACAAATTTCCCCAAAGACTGCGCTAGCTGTCAAATAAAAGACAGTGAAATTGACCT<br>GA |
| SEQ ID<br>NO: 4 | FGFR1<br>isoform 2<br>Amino acid<br>sequence | MWSWKCLLFWAVLVTATLCTARPSPTLPEQAQPWGAPVEVESFLVHPGDLLQLRCRL<br>RDDVQSINWLRDGVQLAESNRTRITGEEVEVQDSVPADSGLYACVTSSPSGSDTTYF<br>SVNVSDALPSSEDDDDDDDSSSEEKETDNTKPNPVAPYWTSPEKMEKKLHAVPAAKT<br>VKFKCPSSGTPNPTLRWLKNGKEFKPDHRIGGYKVRYATWSIIMDSVVPSDKGNYTC<br>IVENEYGSINHTYQLDVVERSPHRPILQAGLPANKTVALGSNVEFMCKVYSDPQPHI<br>QWLKHIEVNGSKIGPDNLPYVQILKTAGVNTTDKEMEVLHLRNVSFEDAGEYTCLAG<br>NSIGLSHHSAWLTVLEALEERPAVMTSPLYLEIIIYCTGAFLISCMVGSVIVYKMKS<br>GTKKSDFHSQMAVHKLAKSIPLRRQVTVSADSSASMNSGVLLVRPSRLSSSGTPMLA<br>GVSEYELPEDPRWELPRDRLVLGKPLGEGCFGQVVLAEAIGLDKDPNRVTKVAVKM<br>LKSDATEKDLSDLISEMEMMKMIGKHKNIINLLGACTQDGPLYVIVEYASKGNLREY<br>LQARRPPGLEYCYNPSHNPEEQLSSKDLVSCAYQVARGMEYLASKKCIHRDLAARNV<br>LVTEDNVMKIADFGLARDIHHIDYYKKTTNGRLPVKWMAPEALFDRIYTHQSDVWSF<br>GVLLWEIFTLGGSPYPGVPVEELFKLLKEGHRMDKPSNCTNELYMMMRDCWHAVPSQ<br>RPTFKQLVEDLDRIVALTSNQEYLDLSMPLDQYSPSFPDTRSSTCSSGEDSVFSHEP<br>LPEEPCLRHPAQLANGGLKRR |
| SEQ ID<br>NO: 5 | FGFR1<br>isoform 3<br>Nucleic acid<br>sequence | AGCGCTCTTGCGGCCACAGGCGCGGCGTCCTCGGCGGCGGGCGGCAGCTAGCGGGAG<br>CCGGGACGCCGGTGCAGCCGCAGCGCGCGGAGGAACCCGGGTGTGCCGGGAGCTGGG<br>CGGCCACGTCCGGACGGGACCGAGACCCCTCGTAGCGCATTGCGGCGACCTCGCCTT<br>CCCCGGCCGCGAGCGCCGCCGCTGCTTGAAAAGCCGCGGAACCCAAGGACTTTTCTC<br>GGTCCGAGCTCGGGCGCCCCGCAGGGCGCACGGTACCCGTGCTGCAGTCGGGCACG<br>CCGGCGCCGGGGCCTCCGCAGGGCGATGGAGCCCGGTCTGCAAGGGAAAGTGAGGC<br>GCCGCCGCTGCGTTCTGGAGGAGGGGGGCACAAGGTCTGGAGACCCCGGGTGGCGGA<br>CGGGAGCCCTCCCCCCGCCCGCTCCGGGGCACCTCCAGCTCCGGCTCCATTGTTCCCG<br>CCCGGGCTGGAGGCGCCGAGCACCGAGCGCCGCGGGAGTCGAGCGCCGCCGCGGA<br>GCTCTTGCGACCCCGCCAGGACCCGAACAGAGCCCGGGGGCGCGGGCGGAGCCGG<br>GGACGCGGGCACACGCCCGCTCGCACAAGCCACGGCGGACTCTCCCGAGGCGGAACC<br>TCCACGCCGAGCGAGGGTCAGTTTGAAAGGAGGATCGAGCTCACTGTGGAGTATCC<br>ATGGAGATGTGGAGCCTTGTCACCAACCTCTAACTGCAGAACTGGGATGTGGAGCTG |

TABLE 5-continued

FGFR sequences.

```
GAAGTGCCTCCTCTTCTGGGCTGTGCTGGTCACAGCCACACTCTGCACCGCTAGGCC
GTCCCCGACCTTGCCTGAACAAGCCCAGCCCTGGGGAGCCCCTGTGGAAGTGGAGTC
CTTCCTGGTCCACCCCGGTGACCTGCTGCAGCTTCGCTGTCGGCTGCGGGACGATGT
GCAGAGCATCAACTGGCTGCGGGACGGGGTGCAGCTGGCGGAAAGCAACCGCACCCG
CATCACAGGGGAGGAGGTGGAGGTGCAGGACTCCGTGCCCGCAGACTCCGGCCTCTA
TGCTTGCGTAACCAGCAGCCCCTCGGGCAGTGACACCACCTACTTCTCCGTCAATGT
TTCAGATGCTCTCCCCTCCTCGGAGGATGATGATGATGATGACTCCTCTTCAGA
GGAGAAAGAAACAGATAACACCAAACCAAACCGTATGCCCGTAGCTCCATATTGGAC
ATCCCCAGAAAAGATGGAAAAGAAATTGCATGCAGTGCCGGCTGCCAAGACAGTGAA
GTTCAAATGCCCTTCCAGTGGGACCCCAAACCCCACACTGCGCTGGTTGAAAAATGG
CAAAGAATTCAAACCTGACCACAGAATTGGAGGCTACAAGGTCCGTTATGCCACCTG
GAGCATCATAATGGACTCTGTGGTGCCCTCTGACAAGGGCAACTACACCTGCATTGT
GGAGAATGAGTACGGCAGCATCAACCACACATACCAGCTGGATGTCGTGGAGCGGTC
CCCTCACCGGCCCATCCTGCAAGCAGGGTTGCCCGCCAACAAAACAGTGGCCCTGGG
TAGCAACGTGGAGTTCATGTGTAAGGTGTACAGTGACCCGCAGCCGCACATCCAGTG
GCTAAAGCACATCGAGGTGAATGGGAGCAAGATTGGCCCAGACAACCTGCCTTATGT
CCAGATCTTGAAGACTGCTGGAGTTAATACCACCGACAAAGAGATGGAGGTGCTTCA
CTTAAGAAATGTCTCCTTTGAGGACGCAGGGGAGTATACGTGCTTGGCGGGTAACTC
TATCGGACTCTCCCATCACTCTGCATGTTGACCGTTCTGGAAGCCCTGGAAGAGAG
GCCGGCAGTGATGACCTCGCCCCTGTACCTGGAGATCATCATCTATTGCACAGGGGC
CTTCCTCATCTCCTGCATGGTGGGGTCGGTCATCGTCTACAAGATGAAGAGTGGTAC
CAAGAAGAGTGACTTCCACAGCCAGATGGCTGTGCACAAGCTGGCCAAGAGCATCCC
TCTGCGCAGACAGGTGTCTGCTGACTCCAGTGCATCCATGAACTCTGGGGTTCTTCT
GGTTCGGCCATCACGGCTCTCCTCCAGTGGGACTCCCATGCTAGCAGGGGTCTCTGA
GTATGAGCTTCCCGAAGACCCTCGCTGGGAGCTGCCTCGGGACAGACTGGTCTTAGG
CAAACCCCTGGGAGAGGGCTGCTTTGGGCAGGTGGTGTTGGCAGAGGCTATCGGGCT
GGACAAGGACAAACCCAACCGTGTGACCAAAGTGGCTGTGAAGATGTTGAAGTCGGA
CGCAACAGAGAAAGACTTGTCAGACCTGATCTCAGAAATGGAGATGATGAAGATGAT
CGGGAAGCATAAGAATATCATCAACCTGCTGGGGGCCTGCACGCAGGATGGTCCCTT
GTATGTCATCGTGGAGTATGCCTCCAAGGGCAACCTGCGGGAGTACCTGCAGGCCCG
GAGGCCCCCAGGGCTGGAATACTGCTACAACCCCAGCCACAACCCAGAGGAGCAGCT
CTCCTCCAAGGACCTGGTGTCCTGCGCCTACCAGGTGGCCCGAGGCATGGAGTATCT
GGCCTCCAAGAAGTGCATACACCGAGACCTGGCAGCCAGGAATGTCCTGGTGACAGA
GGACAATGTGATGAAGATAGCAGACTTTGGCCTCGCACGGGACATTCACCACATCGA
CTACTATAAAAAGACAACCAACGGCCGACTGCCTGTGAAGTGGATGGCACCCGAGGC
ATTATTTGACCGGATCTACACCCACCAGAGTGATGTGTGGTCTTTCGGGGTGCTCCT
GTGGGAGATCTTCACTCTGGGCGGCTCCCCATACCCCGGTGTGCCTGTGGAGGAACT
TTTCAAGCTGCTGAAGGAGGGTCACCGCATGGACAAGCCCAGTAACTGCACCAACGA
GCTGTACATGATGATGCGGGACTGCTGGCATGCAGTGCCCTCACAGAGACCCACCTT
CAAGCAGCTGGTGGAAGACCTGGACCGCATCGTGGCCTTGACCTCCAACCAGGAGTA
CCTGGACCTGTCCATGCCCCTGGACCAGTACTCCCCCAGCTTTCCCGACACCCGGAG
CTCTACGTGCTCCTCAGGGGAGGATTCCGTCTTCTCTCATGAGCCGCTGCCCGAGGA
GCCCTGCCTGCCCCGACACCCAGCCCAGCTTGCCAATGGCGGACTCAAACGCCGCTG
ACTGCCACCCACACGCCCTCCCCAGACTCCACCGTCAGCTGTAACCCTCACCCACAG
CCCCTGCTGGGCCCACCACCTGTCCGTCCCTGTCCCCTTTCCTGCTGGCAGGAGCCG
GCTGCCTACCAGGGGCCTTCCTGTGTGGCCTGCCTTCACCCCACTCAGCTCACCTCT
CCCTCCACCTCCTCTCCACCTGCTGGTGAGAGGTGCAAAGAGGCAGATCTTTGCTGC
CAGCCACTTCATCCCCTCCCAGATGTTGGACCAACACCCCTCCCTGCCACCAGGCAC
TGCCTGGAGGGCAGGGAGTGGGAGCCAATGAACAGGCATGCAAGTGAGAGCTTCCTG
AGCTTTCTCCTGTCGGTTTGGTCTGTTTTGCCTTCACCCATAAGCCCCTCGCACTCT
GGTGGCAGGTGCCTTGTCCTCAGGGCTACAGCAGTAGGGAGGTCAGTGCTTCGTGCC
TCGATTGAAGGTGACCTCTGCCCCAGATAGGTGGTGCCAGTGGCTTATTAATTCCGA
TACTAGTTTGCTTTGCTGACCAAATGCCTGGTACCAGAGGATGGTGAGGCGAAGGCC
AGGTTGGGGGCAGTGTTGTGGCCCTGGGGCCCAGCCCCAAACTGGGGGCTCTGTATA
TAGCTATGAAGAAAACACAAAGTGTATAAATCTGAGTATATATTTACATGTCTTTTT
AAAAGGGTCGTTACCAGAGATTTACCCATCGGGTAAGATGCTCCTGGTGGCTGGGAG
GCATCAGTTGCTATATATTAAAAACAAAAAAGAAAAAAAAGGAAAATGTTTTTAAAA
AGGTCATATATTTTTTGCTACTTTTGCTGTTTTATTTTTTTAAATTATGTTCTAAAC
CTATTTTCAGTTTAGGTCCCTCAATAAAAATTGCTGCTGCTTCATTTATCTATGGGC
TGTATGAAAAGGGTGGGAATGTCCACTGGAAAGAAGGGACACCCACGGGCCCTGGGG
CTAGGTCTGTCCCGAGGGCACCGCATGCTCCCGGCGCAGGTTCCTTGTAACCTCTTC
TTCCTAGGTCCTGCACCCAGACCTCACGACGCACCTCCTGCCTCTCCGCTGCTTTTG
GAAAGTCAGAAAAAGAAGATGTCTGCTTCGAGGGCAGGAACCCCATCCATGCAGTAG
AGGCGCTGGGCAGAGAGTCAAGGCCCAGCAGCCATCGACCATGGATGGTTTCCTCCA
AGGAAACCGGTGGGGTTGGGCTGGGGAGGGGCCACCTACCTAGGAATAGCCACGGGG
TAGAGCTACAGTGATTAAGAGGAAAGCAAGGGCGCGGTTGCTCACGCCTGTAATCCC
AGCACTTTGGACACCGAGGTGGGCAGATCACTTCAGGTCAGGAGTTTGAGACCAGC
CTGGCCAACTTAGTGAAACCCCATCTCTACTAAAAATGCAAAAATTATCCAGGCATG
GTGGCACACGCCTGTAATCCCAGCTCCACAGGAGGCTGAGGCAGAATCCCTTGAAGC
TGGGAGGCGGAGGTTGCAGTGAGCCGAGATTGCGCCATTGCACTCCAGCCTGGGCAA
CAGAGAAACAAAAGGAAAACAAATGATGAAGGTCTGCAGAAACTGAAACCCAGAC
ATGTGTCTGCCCCCTCTATGTGGGCATGGTTTTGCCAGTGCTTCTAAGTGCAGGAGA
ACATGTCACCTGAGGCTAGTTTTCCATTCAGGTCCCTGGCTTCGTTCTTGTTGGTA
TGCCTCCCCAGATCGTCCTTCCTGTATCCATGTGACCAGACTGTATTTGTTGGGACT
GTCGCAGATCTTGGCTTCTTACAGTTCTTCCTGTCCAAACTCCATCCTGTCCCTCAG
GAACGGGGGAAAATTCTCCGAATGTTTTTGGTTTTTTGGCTGCTTGGAATTTACTT
CTGCCACCTGCTGGTCATCACTGTCCTCACTAAGTGGATTCTGGCTCCCCCGTACCT
CATGGCTCAAACTACCACTCCTCAGTCGCTATATTAAAGCTTATATTTTGCTGGATT
```

TABLE 5-continued

FGFR sequences.

ACTGCTAAATACAAAAGAAAGTTCAATATGTTTTCATTTCTGTAGGGAAAATGGGAT
TGCTGCTTTAAATTTCTGAGCTAGGGATTTTTTGGCAGCTGCAGTGTTGGCGACTAT
TGTAAAATTCTCTTTGTTTCTCTCTGTAAATAGCACCTGCTAACATTACAATTTGTA
TTTATGTTTAAAGAAGGCATCATTTGGTGAACAGAACTAGGAAATGAATTTTTAGCT
CTTAAAAGCATTTGCTTTGAGACCGCACAGGAGTGTCTTTCCTTGTAAAACAGTGAT
GATAATTTCTGCCTTGGCCCTACCTTGAAGCAATGTTGTGTGAAGGGATGAAGAATC
TAAAAGTCTTCATAAGTCCTTGGGAGAGGTGCTAGAAAAATATAAGGCACTATCATA
ATTA

| SEQ ID NO: 6 | FGFR1 isoform 3 Amino acid sequence | MWSWKCLLFWAVLVTATLCTARPSPTLPEQAQPWGAPVEVESFLVHPGDLLQLRCRL RDDVQSINWLRDGVQLAESNRTRITGEEVEVQDSVPADSGLYACVTSSPSGSDTTYF SVNVSDALPSSEDDDDDDDSSSEEKETDNTKPNRMPVAPYWTSPEKMEKKLHAVPAA KTVKFKCPSSGTPNPTLRWLKNGKEFKPDHRIGGYKVRYATWSIIMDSVVPSDKGNY TCIVENEYGSINHTYQLDVVERSPHRPILQAGLPANKTVALGSNVEFMCKVYSDPQP HIQWLKHIEVNGSKIGPDNLPYVQILKTAGVNTTDKEMEVLHLRNVSFEDAGEYTCL AGNSIGLSHHSAWLTVLEALEERPAVMTSPLYLEIIIYCTGAFLISCMVGSVIVYKM KSGTKKSDFHSQMAVHKLAKSIPLRRQVSADSSASMNSGVLLVRPSRLSSSGTPMLA GVSEYELPEDPRWELPRDRLVLGKPLGEGCFGQVVLAEAIGLDKDKPNRVTKVAVKM LKSDATEKDLSDLISEMEMMKMIGKHKNIINLLGACTQDGPLYVIVEYASKGNLREY LQARRPPGLEYCYNPSHNPEEQLSSKDLVSCAYQVARGMEYLASKKCIHRDLAARNV LVTEDNVMKIADFGLARDIHHIDYYKKTTNGRLPVKWMAPEALFDRIYTHQSDVWSF GVLLWEIFTLGGSPYPGVPVEELFKLLKEGHRMDKPSNCTNELYMMMRDCWHAVPSQ RPTFKQLVEDLDRIVALTSNQEYLDLSMPLDQYSPSFPDTRSSTCSSGEDSVFSHEP LPEEPCLRHPAQLANGGLKRR |
| --- | --- | --- |
| SEQ ID NO: 7 | FGFR1 isoform 4 Nucleic acid sequence | CCCTTTCACCTCCTGGCTCCCTCCCGGGCGATCCGCGCCCCTTGGGTCTCCCCTCCC TTCCCTCCGTCCGCGTCTCGCGCCCCTCCCTGCGCTCGTCCCCGCCGCTCTTCCC GCCGCCCAACTTTTCCTCCAACTCGCGCTCGGGAGCTGGCGAGGCGGCGGCGGCTCC TCAAAGTGGGAGAGCTTCAAGGTCACGTGGTCCGTCCAGCCCTGCTATCTCACCAG ACACTGTCCACCCTGTATGTTGGATCAGTACTCCAGTGAGAAGACAGCAGGCACTTT CACCCATGCAGCCCATTCAGTCTTCATAACCACCTGTGATGGAGGCAAGGGTCAGTT TGAAAAGGAGGATCGAGCTCACTGTGGAGTATCCATGGAGATGTGGAGCCTTGTCAC CAACCTCTAACTGCAGAACTGGGATGTGGAGCTGGAAGTGCCTCCTCTTCTGGGCTG TGCTGGTCACAGCCACACTCTGCACCGCTAGGCCGTCCCCGACCTTGCCTGAACAAG CCCAGCCCTGGGGAGCCCCTGTGGAAGTGGAGTCCTTCCTGGTCCACCCCGGTGACC TGCTGCAGCTTCGCTGTCGGCTGCGGGACGATGTGCAGAGCATCAACTGGCTGCGGG ACGGGGTGCAGCTGGCGGAAAGCAACCGCACCCGCATCACAGGGGAGGAGGTGGAGG TGCAGGACTCCGTGCCCGCAGACTCCGGCCTCTATGCTTGCGTAACCAGCAGCCCT CGGGCAGTGACACCACCTACTTCTCCGTCAATGTTTCAGATGCTCTCCCCTCCTCGG AGGATGATGATGATGATGATGATGATGATGATGATCCTCTTCAGAGGAGAAAGAAACAGATAACACCA AACCAAACCCCGTAGCTCCATATTGGACATCCCCAGAAAAGATGGAAAAGAAATTGC ATGCAGTGCCGGCTGCCAAGACAGTGAAGTTCAAATGCCCTTCCAGTGGGACCCCAA ACCCCACACTGCGCTGGTTGAAAAATGGCAAAGAATTCAAACCTGACCACAGAATTG GAGGCTACAAGGTCCGTTATGCCACCTGGAGCATCATAATGGACTCTGTGGTGCCCT CTGACAAGGGCAACTACACCTGCATTGTGGAGAATGAGTACGGCAGCATCAACCACA CATACCAGCTGGATGTCGTGGAGCGGTCCCCTCACCGGCCCATCCTGCAAGCAGGGT TGCCCGCCAACAAACAGTGGCCCTGGGTAGCAACGTGGAGTTCATGTGTAAGGTGT ACAGTGACCCGCAGCCGCACATCCAGTGGCTAAAGCACATCGAGGTGAATGGGAGCA AGATTGGCCCAGACAACCTGCCTTATGTCCAGATCTTGAAGACTGCTGGAGTTAATA CCACCGACAAAGAGATGGAGGTGCTTCACTTAAGAAATGTCTCCTTTGAGGACGCAG GGGAGTATACGTGCTTGGCGGGTAACTCTATCGGACTCTCCCATCACTCTGCATGGT TGACCGTTCTGGAAGCCCTGGAAGAGAGGCCGGCAGTGATGACCTCGCCCCTGTACC TGGAGATCATCATCTATTGCACAGGGGCCTTCCTCATCTCCTGCATGGTGGGGTCGG TCATCGTCTACAAGATGAAGAGTGGTACCAAGAAGAGTGACTTCCACAGCCAGATGG CTGTGCACAAGCTGGCCAAGAGCATCCCTCTGCGCAGACAGGTAACAGTGTCTGCTG ACTCCAGTGCATCCATGAACTCTGGGGTTCTTCTGGTTCGGCCATCACGGCTCTCCT CCAGTGGGACTCCCATGCTAGCAGGGGTCTCTGAGTATGAGCTTCCCGAAGACCCTC GCTGGGAGCTGCCTCGGGACAGACTGGTCTTAGGCAAACCCCTGGGAGAGGGCTGCT TTGGGCAGGTGGTGTTGGCAGAGGCTATCGGGCTGGACAAGGACAAACCCAACCGTG TGACCAAAGTGGCTGTGAAGATGTTGAAGTCGGACGCAACAGAGAAAGACTTGTCAG ACCTGATCTCAGAAATGGAGATGATGAAGATGATCGGGAAGCATAAGAATATCATCA ACCTGCTGGGGGCCTGCACGCAGGATGGTCCCTTGTATGTCATCGTGGAGTATGCCT CCAAGGGCAACCTGCGGGAGTACCTGCAGGCCCGGAGGCCCCAGGGCTGGAATACT GCTACAACCCCAGCCACAACCCAGAGGAGCAGCTCTCCTCCAAGGACCTGGTGTCCT GCGCCTACCAGGTGGCCCGAGGCATGGAGTATCTGGCCTCCAAGAAGTGCATACACC GAGACCTGGCAGCCAGGAATGTCCTGGTGACAGAGGACAATGTGATGAAGATAGCAG ACTTTGGCCTCGCACGGGACATTCACCACATCGACTACTATAAAAAGACAACCAACG GCCGACTGCCTGTGAAGTGGATGGCACCCGAGGCATTATTTGACCGGATCTACACCC ACCAGAGTGATGTGTGGTCTTTCGGGGTGCTCCTGTGGGAGATCTTCACTCTGGGCG GCTCCCCATACCCCGGTGTGCCTGTGGAGGAACTTTTCAAGCTGCTGAAGGAGGGTC ACCGCATGGACAAGCCCAGTAACTGCACCAACGAGCTGTACATGATGATGCGGGACT GCTGGCATGCAGTGCCCTCACAGAGACCCACCTTCAAGCAGCTGGTGGAAGACCTGG ACCGCATCGTGGCCTTGACCTCCAACCAGGAGTACCTGGACCTGTCCATGCCCCTGG ACCAGTACTCCCCCAGCTTTCCCGACACCCGGAGCTCTACGTGCTCCTCAGGGGAGG ATTCCGTCTTCTCTCATGAGCCGCTGCCCGAGGAGCCCTGCCTGCCCCGACACCCAG CCCAGCTTGCCAATGGCGGACTCAAACGCCGCTGACTGCCACCCACACGCCCTCCCC AGACTCCACCGTCAGCTGTAACCCTCACCCACAGCCCCTGCTGGGCCCACCACCTGT CCGTCCCTGTCCCCTTTCCTGCTGGCAGGAGCCGGCTGCCTACCAGGGGCCTTCCTG |

TABLE 5-continued

FGFR sequences.

|  |  |  |
|---|---|---|
|  |  | TGTGGCCTGCCTTCACCCCACTCAGCTCACCTCTCCCTCCACCTCCTCTCCACCTGC<br>TGGTGAGAGGTGCAAAGAGGCAGATCTTTGCTGCCAGCCACTTCATCCCCTCCCAGA<br>TGTTGGACCAACACCCCTCCCTGCCACCAGGCACTGCCTGGAGGGCAGGGAGTGGGA<br>GCCAATGAACAGGCATGCAAGTGAGAGCTTCCTGAGCTTTCTCCTGTCGGTTTGGTC<br>TGTTTTGCCTTCACCCATAAGCCCCTCGCACTCTGGTGGCAGGTGCCTTGTCCTCAG<br>GGCTACAGCAGTAGGGAGGTCAGTGCTTCGTGCCTCGATTGAAGGTGACCTCTGCCC<br>CAGATAGGTGGTGCCAGTGGCTTATTAATTCCGATACTAGTTTGCTTTGCTGACCAA<br>ATGCCTGGTACCAGAGGATGGTGAGGCGAAGGCCAGGTTGGGGGCAGTGTTGTGGCC<br>CTGGGGCCCAGCCCCAAACTGGGGGCTCTGTATATAGCTATGAAGAAAACACAAAGT<br>GTATAAATCTGAGTATATATTTACATGTCTTTTTAAAAGGGTCGTTACCAGAGATTT<br>ACCCATCGGGTAAGATGCTCCTGGTGGCTGGGAGGCATCAGTTGCTATATATTAAAA<br>ACAAAAAAGAAAAAAAGGAAAATGTTTTTAAAAAGGTCATATATTTTTTGCTACTT<br>TTGCTGTTTTATTTTTTTAAATTATGTTCTAAACCTATTTTCAGTTTAGGTCCCTCA<br>ATAAAAATTGCTGCTGCTTCATTTATCTATGGGCTGTATGAAAAGGGTGGGAATGTC<br>CACTGGAAAGAAGGGACACCCACGGGCCCTGGGGCTAGGTCTGTCCCGAGGGCACCG<br>CATGCTCCCGGCGCAGGTTCCTTGTAACCTCTTCTTCCTAGGTCCTGCACCCAGACC<br>TCACGACGCACCTCCTGCCTCTCCGCTGCTTTTGGAAAGTCAGAAAAAGAAGATGTC<br>TGCTTCGAGGGCAGGAACCCCATCCATGCAGTAGAGGCGCTGGGCAGAGAGTCAAGG<br>CCCAGCAGCCATCGACCATGGATGGTTTCCTCCAAGGAAACCGGTGGGGTTGGGCTG<br>GGGAGGGGGCACCTACCTAGGAATAGCCACGGGGTAGAGCTACAGTGATTAAGAGGA<br>AAGCAAGGGCGCGGTTGCTCACGCCTGTAATCCCAGCACTTTGGGACACCGAGGTGG<br>GCAGATCACTTCAGGTCAGGAGTTTGAGACCAGCCTGGCCAACTTAGTGAAACCCCA<br>TCTCTACTAAAAATGCAAAAATTATCCAGGCATGGTGGCACACGCCTGTAATCCCAG<br>CTCCACAGGAGGCTGAGGCAGAATCCCTTGAAGCTGGGAGGCGGAGGTTGCAGTGAG<br>CCGAGATTGCGCCATTGCACTCCAGCCTGGGCAACAGAGAAACAAAAGGGAAACA<br>AATGATGAAGGTCTGCAGAAACTGAAACCCAGACATGTGTCTGCCCCCTCTATGTGG<br>GCATGGTTTTGCCAGTGCTTCTAAGTGCAGGAGAACATGTCACCTGAGGCTAGTTTT<br>GCATTCAGGTCCCTGGCTTCGTTTCTTGTTGGTATGCCTCCCCAGATCGTCCTTCCT<br>GTATCCATGTGACCAGACTGTATTTGTTGGGACTGTCGCAGATCTTGGCTTCTTACA<br>GTTCTTCCTGTCCAAACTCCATCCTGTCCCTCAGGAACGGGGGAAAATTCTCCGAA<br>TGTTTTTGGTTTTTTGGCTGCTTGGAATTTACTTCTGCCACCTGCTGGTCATCACTG<br>TCCTCACTAAGTGGATTCTGGCTCCCCCGTACCTCATGGCTCAAACTACCACTCCTC<br>AGTCGCTATATTAAAGCTTATATTTTGCTGGATTACTGCTAAATACAAAAGAAAGTT<br>CAATATGTTTTCATTTCTGTAGGGAAAATGGGATTGCTGCTTTAAATTTCTGAGCTA<br>GGGATTTTTTGGCAGCTGCAGTGTTGGCGACTATTGTAAAATTCTCTTTGTTTCTCT<br>CTGTAAATAGCCACCTGCTAACATTACAATTTGTATTTATGTTTAAAGAAGGCATCAT<br>TTGGTGAACAGAACTAGGAAATGAATTTTTAGCTCTTAAAAGCATTTGCTTTGAGAC<br>CGCACAGGAGTGTCTTTCCTTGTAAAACAGTGATGATAATTTCTGCCTTGGCCCTAC<br>CTTGAAGCAATGTTGTGTGAAGGGATGAAGAATCTAAAAGTCTTCATAAGTCCTTGG<br>GAGAGGTGCTAGAAAAATATAAGGCACTATCATAATTACAGTGATGTCCTTGCTGTT<br>ACTACTCAAATCACCCACAAATTTCCCCAAAGACTGCGCTAGCTGTCAAATAAAAGA<br>CAGTGAAATTGACCTGA |
| SEQ ID<br>NO: 8 | FGFR1<br>isoform 4<br>Amino acid<br>sequence | MEARVSLKRRIELTVEYPWRCGALSPTSNCRTGMWSWKCLLFWAVLVTATLCTARPS<br>PTLPEQAQPWGAPVEVESFLVHPGDLLQLRCRLRDDVQSINWLRDGVQLAESNRTRI<br>TGEEVEVQDSVPADSGLYACVTSSPSGSDTTYFSVNVSDALPSSEDDDDDDDSSSEE<br>KETDNTKPNPVAPYWTSPEKMEKKLHAVPAAKTVKFKCPSSGTPNPTLRWLKNGKEF<br>KPDHRIGGYKVRYATWSIIMDSVVPSDKGNYTCIVENEYGSINHTYQLDVVERSPHR<br>PILQAGLPANKTVALGSNVEFMCKVYSDPQPHIQWLKHIEVNGSKIGPDNLPYVQIL<br>KTAGVNTTDKEMEVLHLRNVSFEDAGEYTCLAGNSIGLSHHSAWLTVLEALEERPAV<br>MTSPLYLEIIIYCTGAFLISCMVGSVIVYKMKSGTKKSDFHSQMAVHKLAKSIPLRR<br>QVTVSADSSASMNSGVLLVRPSRLSSSGTPMLAGVSEYELPEDPRWELPRDRLVLGK<br>PLGEGCFGQVVLAEAIGLDKDKPNRVTKVAVKMLKSDATEKDLSDLISEMEMMKMIG<br>KHKNIINLLGACTQDGPLYVIVEYASKGNLREYLQARRPPGLEYCYNPSHNPEEQLS<br>SKDLVSCAYQVARGMEYLASKKCIHRDLAARNVLVTEDNVMKIADFGLARDIHHIDY<br>YKKTTNGRLPVKWMAPEALFDRIYTHQSDVWSFGVLLWEIFTLGGSPYPGVPVEELF<br>KLLKEGHRMDKPSNCTNELYMMMRDCWHAVPSQRPTFKQLVEDLDRIVALTSNQEYL<br>DLSMPLDQYSPSFPDTRSSTCSSGEDSVFSHEPLPEEPCLPRHPAQLANGGLKRR |
| SEQ ID<br>NO: 9 | FGFR1<br>isoform 5<br>Nucleic acid<br>sequence | GCGCTCTTGCGGCCACAGGCGCGGCGTCCTCGGCGGCGGGCGGCAGCTAGCGGGAGC<br>CGGGACGCCGGTGCAGCCGCAGCGCGCGGAGGAACCCGGGTGTGCCGGGAGCTGGGC<br>GGCCACGTCCGGACGGGACCGAGACCCCTCGTAGCGCATTGCGGCGACCTCGCCTTC<br>CCCGGCCGCGAGCGCGCCGCTGCTTGAAAAGCCGCGGAACCCAAGGACTTTTCTCCG<br>GTCCGAGCTCGGGGCGCCCCGCAGGGCGCACGGTACCCGTGCTGCAGTCGGGCACGC<br>CGCGGCGCCGGGGCCTCCGCAGGGCGATGGAGCCCGGTCTGCAAGGAAAGTGAGGCG<br>CCGCCGCTGCCGTTCTGGAGGAGGGGGCACAAGGTCTGGAGACCCCGGGTGGCGGAC<br>GGGAGCCCTCCCCCCGCCCCGCCTCCGGGGCACCAGCTCCGGCTCCATTGTTCCCGC<br>CCGGGCTGGAGGCGCCGAGCACCGAGCGCCGCCGGGAGTCGAGCGCCGGCCGCGGAG<br>CTCTTGCGACCCCGCCAGGACCCGAACAGAGCCCGGGGGCGGCGGGCCGGAGCCGGG<br>GACGCGGGCACACGCCCGCTCGCACAAGCCACGCGGGACTCTCCCGAGGCGGAACCT<br>CCACGCCAGCGAGGGTCAGTTGAAAAGGAGGATCGAGCTCACTGTGGAGTATCCA<br>TGGAGATGTGGAGCCTTGTCACCAACCTCTAACTGCAGAACTGGGATGTGGAGCTGG<br>AAGTGCCTCCTCTTCTGGGCTGTGTCGGTGCACGACCACACTCTGCACCGCTAGGCG<br>TCCCCGACCTTGCCTGAACAAGGATGGCAGCTGTGACCCGGGATTTCGGTGAGATGC<br>TTCTGCACTCTGGCCGGGTCCTGCCAGCCGAAGCCCAGCCCTGGGGAGCCCCTGTGG<br>AAGTGGAGTCCTTCCTGGTCCACCCCGGTGACCTGCTGCAGCTTCGCTGTCGGCTGC<br>GGGACGATGTGCAGAGCATCAACTGGCTGCGGGACGGGGTGCAGCTGGCGGAAAGCA<br>ACCGCACCCGCATCACAGGGGAGGAGGTGGAGGTGCAGGACTCCGTGCCCGCAGACT |

TABLE 5-continued

FGFR sequences.

|  |  |  |
|---|---|---|
|  |  | CCGGCCTCTATGCTTGCGTAACCAGCAGCCCCTCGGGCAGTGACACCACCTACTTCT<br>CCGTCAATGTTTCAGATGCTCTCCCCTCCTCGGAGGATGATGATGATGATGATGCT<br>CCTCTTCAGAGGAGAAAGAAACAGATAACACCAAACCAAACCGTATGCCCGTAGCTC<br>CATATTGGACATCCCCAGAAAAGATGGAAAAGAAATTGCATGCAGTGCCGGCTGCCA<br>AGACAGTGAAGTTCAAATGCCCTTCCAGTGGGACCCCAAACCCCACACTGCGCTGGT<br>TGAAAAATGGCAAAGAATTCAAACCTGACCACAGAATTGGAGGCTACAAGGTCCGTT<br>ATGCCACCTGGAGCATCATAATGGACTCTGTGGTGCCCTCTGACAAGGGCAACTACA<br>CCTGCATTGTGGAGAATGAGTACGGCAGCATCAACCACACATACCAGCTGGATGTCG<br>TGGAGCGGTCCCCTCACCGGCCCATCCTGCAAGCAGGGTTGCCCGCCAACAAACAG<br>TGGCCCTGGGTAGCAACGTGGAGTTCATGTGTAAGGTGTACAGTGACCCGCAGCCGC<br>ACATCCAGTGGCTAAAGCACATCGAGGTGAATGGGAGCAAGATTGGCCCAGACAACC<br>TGCCTTATGTCCAGATCTTGAAGACTGCTGGAGTTAATACCACCGACAAAGAGATGG<br>AGGTGCTTCACTTAAGAAATGTCTCCTTTGAGGACGCAGGGGAGTATACGTGCTTGG<br>CGGGTAACTCTATCGGACTCTCCCATCACTCTGCATGGTTGACCGTTCTGGAAGCCC<br>TGGAAGAGAGGCCGGCAGTGATGACCTCGCCCCTGTACCTGGAGATCATCATCTATT<br>GCACAGGGGCCTTCCTCATCTCCTGCATGGTGGGGTCGGTCATCGTCTACAAGATGA<br>AGAGTGGTACCAAGAAGAGTGACTTCCACAGCCAGATGGCTGTGCACAAGCTGGCCA<br>AGAGCATCCCTCTGCGCAGACAGGTGTCTGCTGACTCCAGTGCATCCATGAACTCTG<br>GGGTTCTTCTGGTTCGGCCATCACGGCTCTCCTCCAGTGGGACTCCCATGCTAGCAG<br>GGGTCTCTGAGTATGAGCTTCCCGAAGACCCTCGCTGGGAGCTGCCTCGGGACAGAC<br>TGGTCTTAGGCAAACCCCTGGGAGAGGGCTGCTTTGGGCAGGTGGTGTTGGCAGAGG<br>CTATCGGGCTGGACAAGGACAAACCCAACCGTGTGACCAAAGTGGCTGTGAAGATGT<br>TGAAGTCGGACGCAACAGAGAAAGACTTGTCAGACCTGATCTCAGAAATGGAGATGA<br>TGAAGATGATCGGGAAGCATAAGAATATCATCAACCTGCTGGGGGCCTGCACGCAGG<br>ATGGTCCCTTGTATGTCATCGTGGAGTATGCCTCCAAGGGCAACCTGCGGGAGTACC<br>TGCAGGCCCGGAGGCCCCCAGGGCTGGAATACTGCTACAACCCCAGCCACAACCCAG<br>AGGAGCAGCTCTCCTCCAAGGACCTGGTGTCCTGCGCCTACCAGGTGGCCCGAGGCA<br>TGGAGTATCTGGCCTCCAAGAAGTGCATACACCGAGACCTGGCAGCCAGGAATGTCC<br>TGGTGACAGAGGACAATGTGATGAAGATAGCAGACTTTGGCCTCGCACGGGACATTC<br>ACCACATCGACTACTATAAAAAGACAACCAACGGCCGACTGCCTGTGAAGTGGATGG<br>CACCCGAGGCATTATTTGACCGGATCTACACCCACCAGAGTGATGTGTGGTCTTTCG<br>GGGTGCTCCTGTGGGAGATCTTCACTCTGGGCGGCTCCCCATACCCCGGTGTGCCTG<br>TGGAGGAACTTTTCAAGCTGCTGAAGGAGGGTCACCGCATGGACAAGCCCAGTAACT<br>GCACCAACGAGCTGTACATGATGATGCGGGACTGCTGGCATGCAGTGCCCTCACAGA<br>GACCCACCTTCAAGCAGCTGGTGGAAGACCTGGACCGCATCGTGGCCTTGACCTCCA<br>ACCAGGAGTACCTGGACCTGTCCATGCCCCTGGACCAGTACTCCCCAAGCTTTCCCG<br>ACACCCGGAGCTCTACGTGCTCCTCAGGGGAGGATTCCGTCTTCTCTCATGAGCCGC<br>TGCCCGAGGAGCCCTGCCTGCCCCGACACCCAGCCCAGCTTGCCAATGCGGACTCA<br>AACGCCGCTGACTGCCACCCACACGCCCTCCCAGACTCCACCGTCAGCTGTAACCC<br>TCACCCACAGCCCCTGCTGGGCCCACCACTGTCCGTCCCTGTCCCCTTTCCTGCTG<br>GCAGGAGCCGGCTGCCTACCAGGGGCCTTCCTGTGTGGCCTGCCTTCACCCCACTCA<br>GCTCACCTCTCCCTCCACCTCCTCTCCACCTGCTGGTGAGAGGTGCAAAGAGGCAGA<br>TCTTTGCTGCCAGCCACTTCATCCCCTCCCAGATGTTGGACCAACACCCCTCCCTGC<br>CACCCAGGCACTGCCTGGAGGGCAGGGAGTGGGAGCCAATGAACAGGCATGCAAGTGA<br>GAGCTTCCTGAGCTTTCTCCTGTCGGTTTGGTCTGTTTTGCCTTCACCCATAAGCCC<br>CTCGCACTCTGGTGGCAGGTGCCTTGTCCTCAGGGCTACAGCAGTAGGGAGGTCAGT<br>GCTTCGTGCCTCGATTGAAGGTGACCTCTGCCCCAGATAGGTGGTGCCAGTGGCTTA<br>TTAATTCCGATACTAGTTTGCTTTGCTGACAAATGCCTGGTACCAGAGGATGGTGA<br>GGCGAAGGCCAGGTTGGGGGCAGTGTTGTGGCCCTGGGGCCCAGCCCCAAACTGGGG<br>GCTCTGTATATAGCTATGAAGAAAACACAAAGTGTATAAATCTGAGTATATATTTAC<br>ATGTCTTTTTAAAAGGGTCGTTACCAGAGATTTACCCATCGGGTAAGATGCTCCTGG<br>TGGCTGGGAGGCATCAGTTGCTATATATTAAAAACAAAAAGAAAAAAAAGGAAAAT<br>GTTTTTAAAAAGGTCATATATTTTTTGCTACTTTTGCTGTTTTATTTTTTTAAATTA<br>TGTTCTAAACCTATTTTCAGTTTAGGTCCCTCAATAAAAATTGCTGCTGCTTC |
| SEQ ID<br>NO: 10 | FGFR1<br>isoform 5<br>Amino acid<br>sequence | MAAVTRDFGEMLLHSGRVLPAEAQPWGAPVEVESFLVHPGDLLQLRCRLRDDVQSIN<br>WLRDGVQLAESNRTRITGEEVEVQDSVPADSGLYACVTSSPSGSDTTYFSVNVSDAL<br>PSSEDDDDDDSSSEEKETDNTKPNRMPVAPYWTSPEKMEKKLHAVPAAKTVKFKCP<br>SSGTPNPTLRWLKNGKEFKPDHRIGGYKVRYATWSIIMDSVVPSDKGNYTCIVENEY<br>GSINHTYQLDVVERSPHRPILQAGLPANKTVALGSNVEFMCKVYSDPQPHIQWLKHI<br>EVNGSKIGPDNLPYVQILKTAGVNTTDKEMEVLHLRNVSFEDAGEYTCLAGNSIGLS<br>HHSAWLTVLEALEERPAVMTSPLYLEIIIYCTGAFLISCMVGSVIVYKMKSGTKKSD<br>FHSQMAVHKLAKSIPLRRQVSADSSASMNSGVLLVRPSRLSSSGTPMLAGVSEYELP<br>EDPRWELPRDRLVLGKPLGEGCFGQVVLAEAIGLDKDKPNRVTKVAVKMLKSDATEK<br>DLSDLISEMEMMKMIGKHKNIINLLGACTQDGPLYVIVEYASKGNLREYLQARRPPG<br>LEYCYNPSHNPEEQLSSKDLVSCAYQVARGMEYLASKKCIHRDLAARNVLVTEDNVM<br>KIADFGLARDIHHIDYYKKTTNGRLPVKWMAPEALFDRIYTHQSDVWSFGVLLWEIF<br>TLGGSPYPGVPVEELFKLLKEGHRMDKPSNCTNELYMNMRDCWHAVPSQRPTFKQLV<br>EDLDRIVALTSNQEYLDLSMPLDQYSPSFPDTRSSTCSSGEDSVFSHEPLPEEPCLP<br>RHPAQLANGGLKRR |
| SEQ ID<br>NO: 11 | FGFR1<br>isoform 6<br>Nucleic acid<br>sequence | CTTGCGGCCACAGGCGCGGCGTCCTCGGCGGCGGGCGGCAGCTAGCGGGAGCCGGGA<br>CGCCGGTGCAGCCGCAGCGCGCGGAGGAACCCGGGTGTGCCGGGAGCTGGGCAGCA<br>CGTCCGGACGGGACCGAGACCCCGTCGTAGCGCATTGCGGCGGACCTCGCCTTCCCCGG<br>CCGCCGAGCGCGCCGCTGCTTGAAAAGCCGCGGAACCCAAGGACTTTTCTCCGGTCCG<br>AGCTCGGGCGCCCCGCAGGGCGCACGGTACCCGTGCTGCAGTCGGGCACGCCGCGG<br>CGCCGGGGCCTCCGCAGGGCGATGGAGCCCGGTCTGCAAGGAAAGTGAGGCGCCGCC<br>GCTGCGTTCTGGAGGAGGGGGGCACAAGGTCTGGAGACCCCGGGTGGCGGACGGGAG |

TABLE 5-continued

FGFR sequences.

```
CCCTCCCCCCGCCCCGCCTCCGGGGCACCAGCTCCGGCTCCATTGTTCCCGCCCGGG
CTGGAGGCGCCGAGCCACCGAGCGCCGCCGGGAGTCGAGCGCCGGCCGCGGAGCTCTT
GCGACCCCGCCAGGACCCGAACAGAGCCCGGGGCGGCGGGCCGGAGCCGGGGACGC
GGGCACACGCCCGCTCGCACAAGCCACGGCGGACTCTCCCGAGGCGGAACCTCCACG
CCGAGCGAGGGTCAGTTTGAAAAGGAGGATCGAGCTCACTGTGGAGTATCCATGGAG
ATGTGGAGCCTTGTCACCAACCTCTAACTGCAGAACTGGGATGTGGAGCTGGAAGTG
CCTCCTCTTCTGGGCTGTGCTGGTCACAGCCACACTCTGCACCGCTAGGCCGTCCCC
GACCTTGCCTGAACAAGATGCTCTCCCCTCCTCGGAGGATGATGATGATGATGATGA
CTCCTCTTCAGAGGAGAAAGAAACAGATAACACCAAACCAAACCGTATGCCCGTAGC
TCCATATTGGACATCCCCAGAAAAGATGGAAAAGAAATTGCATGCAGTGCCGGCTGC
CAAGACAGTGAAGTTCAAATGCCCTTCCAGTGGGACCCCAAACCCCACACTGCCGTG
GTTGAAAAATGGCAAAGAATTCAAACCTGACCACAGAATTGGAGGCTACAAGGTCCG
TTATGCCACCTGGAGCATCATAATGGACTCTGTGGTGCCCTCTGACAAGGGCAACTA
CACCTGCATTGTGGAGAATGAGTACGGCAGCATCAACCACACATACCAGCTGGATGT
CGTGGAGCGGTCCCCTCACCGGCCCATCCTGCAAGCAGGGTTGCCCGCCAACAAAAC
AGTGGCCCTGGGTAGCAACGTGGAGTTCATGTGTAAGGTGTACAGTGACCCGCAGCC
GCACATCCAGTGGCTAAAGCACATCGAGGTGAATGGGAGCAAGATTGGCCCAGACAA
CCTGCCTTATGTCCAGATCTTGAAGACTGCTGGAGTTAATACCACCGACAAAGAGAT
GGAGGTGCTTCACTTAAGAAATGTCTCCTTTGAGGACGCAGGGGAGTATACGTGCTT
GGCGGGTAACTCTATCGGACTCTCCCATCACTCTGCATGGTTGACCGTTCTGGAAGC
CCTGGAAGAGAGGCCGGCAGTGATGACCTCGCCCCTGTACCTGGAGATCATCATCTA
TTGCACAGGGGCCTTCCTCATCCTGCATGGTGGGTCGGTCATCGTCTACAAGAT
GAAGAGTGGTACCAAGAAGAGTGACTTCCACAGCCAGATGGCTGTGCACAAGCTGGC
CAAGAGCATCCCTCTGCGCAGACAGGTAACAGTGTCTGCTGACTCCAGTGCATCCAT
GAACTCTGGGGTTCTTCTGGTTCGGCCATCACGGCTCTCCTCAGTGGGACTCCCAT
GCTAGCAGGGGTCTCTGAGTATGAGCTTCCCGAAGACCCTCGCTGGGAGCTGCCTCG
GGACAGACTGGTCTTAGGCAAACCCTGGGAGAGGGCTGCTTTGGGCAGGTGGTGTT
GGCAGAGGCTATCGGGCTGGACAAGGACAAACCCAACCGTGTGACCAAAGTGGCTGT
GAAGATGTTGAAGTCGGACGCAACAGAGAAGACTTGTCAGACCTGATCTCAGAAAT
GGAGATGATGAAGATGATCGGGAAGCATAAGAATATCATCAACCTGCTGGGGCCTG
CACGCAGGATGGTCCCTTGTATGTCATCGTGGAGTATGCCTCCAAGGGCAACCTGCG
GGAGTACCTGCAGGCCCGGAGGCCCCCAGGGCTGGAATACTGCTACAACCCCAGCCA
CAACCCAGAGGAGCAGCTCTCCTCCAAGGACCTGGTGTCCTGCGCCTACCAGGTGGC
CCGAGGCATGGAGTATCTGGCCTCCAAGAAGTGCATACACCGAGACCTGGCAGCCAG
GAATGTCCTGGTGACAGAGGACAATGTGATGAAGATAGCAGACTTTGGCCTCGCACG
GGACATTCACCACATCGACTACTATAAAAAGACAACCAACGGCCGACTGCCTGTGAA
GTGGATGGCACCCGAGGCATTATTTGACCGGATCTACACCCACCAGAGTGATGTGTG
GTCTTTCGGGGTGCTCCTGTGGGAGATCTTCACTCTGGGCGGCTCCCCATACCCCGG
TGTGCCTGTGGAGGAACTTTTCAAGCTGCTGAAGGAGGGTCACCGCATGGACAAGCC
CAGTAACTGCACCAACGAGCTGTACATGATGATGCGGGACTGCTGGCATGCAGTGCC
CTCACAGAGACCCACCTTCAAGCAGCTGGTGGAAGACCTGGACCGCATCGTGGCCTT
GACCTCCAACCAGGAGTACCTGGACCTGTCCATGCCCCTGGACCAGTACTCCCCCAG
CTTTCCCGACACCCGGAGCTCTACGTGCTCCTCAGGGGAGGATTCCGTCTTCTCTCA
TGAGCCGCTGCCCGAGGAGCCCTGCCTGCCCCGACACCCAGCCAGCTTGCCAATGG
CGGACTCAAACGCCGCTGACTGCCACCCACACGCCCTCCCCAGACTCCACCGTCAGC
TGTAACCCTCACCCACAGCCCCTGCTGGGCCCACCACCTGTCCGTCCCTGTCCCCTT
TCCTGCTGGCAGGAGCCGGCTGCCTACCAGGGGCCTTCCTGTGTGGCCTGCCTTCAC
CCCACTCAGCTCACCTCTCCCTCCACCTCCTCTCCACCTGCTGGTGAGAGGTGCAAA
GAGGCAGATCTTTGCTGCCAGCCACTTCATCCCCTCCCAGATGTTGGACCAACACCC
CTCCCTGCCACCAGGCACTGCCTGGAGGGCAGGGAGTGGGAGCCAATGAACAGGCAT
GCAAGTGAGAGCTTCCTGAGCTTTCTCCTGTCGGTTTGGTCTGTTTTGCCTTCACCC
ATAAGCCCCTCGCACTCTGGTGGCAGGTGCCTTGTCCTCAGGGCTACAGCAGTAGGG
AGGTCAGTGCTTCGTGCCTCGATTGAAGGTGACCTCTGCCCCAGATAGGTGGTGCCA
GTGGCTTATTAATTCCGATACTAGTTTGCTTTGCTGACCAAATGCCTGGTACCAGAG
GATGGTGAGGCGAAGGCCAGGTTGGGGGCAGTGTTGTGGCCCTGGGGCCCAGCCCCA
AACTGGGGGCTCTGTATATAGCTATGAAGAAAACACAAAGTGTATAAATCTGAGTAT
ATATTTACATGTCTTTTTAAAAGGGTCGTTACCAGAGATTTACCCATCGGGTAAGAT
GCTCCTGGTGGCTGGGAGGCATCAGTTGCTATATATTAAAAACAAAAAAGAAAAAAA
AGGAAAATGTTTTTAAAAAGGTCATATATTTTTTGCTACTTTTGCTGTTTTATTTTT
TTAAATTATGTTCTAAACCTATTTTCAGTTTAGGTCCCTCAATAAAATTGCTGCTG
CTTCA
```

| SEQ ID NO: 12 | FGFR1 isoform 6 Amino acid sequence | MWSWKCLLFWAVLVTATLCTARPSPTLPEQDALPSSEDDDDDDSSSEEKETDNTKP NRMPVAPYWTSPEKMEKKLHAVPAAKTVKFKCPSSGTPNPTLRWLKNGKEFKPDHRI GGYKVRYATWSIIMDSVVPSDKGNYTCIVENEYGSINHTYQLDVVERSPHRPILQAG LPANKTVALGSNVEFMCKVYSDPQPHIQWLKHIEVNGSKIGPDNLPYVQILKTAGVN TTDKEMEVLHLRNVSFEDAGEYTCLAGNSIGLSHHSAWLTVLEALEERPAVMTSPLY LEIIIYCTGAFLISCMVGSVIVYKMKSGTKKSDFHSQMAVHKLAKSIPLRRQVTVSA DSSASMNSGVLLVRPSRLSSSGTPMLAGVSEYELPEDPRWELPRDRLVGKPLGEGC FGQVVLAEAIGLDKDKPNRVTKVAVKMLKSDATEKDLSDLISEMEMMKMIGKHKNII NLLGACTQDGPLYVIVEYASKGNLREYLQARRPPGLEYCYNPSHNPEEQLSSKDLVS CAYQVARGMEYLASKKCIHRDLAARNVLVTEDNVMKIADFGLARDIHHIDYYKKTTN GRLPVKWMAPEALFDRIYTHQSDVWSFGVLLWEIFTLGGSPYPGVPVEELFKLLKEG HRMDKPSNCTNELYMMMRDCWHAVPSQRPTFKQLVEDLDRIVALTSNQEYLDLSMPL DQYSPSFPDTRSSTCSSGEDSVFSHEPLPEEPCLPRHPAQLANGGLKRR |

TABLE 5-continued

| FGFR sequences. | | |
|---|---|---|
| SEQ ID NO: 13 | FGFR1 isoform 7 Nucleic acid sequence | CTTGCGGCCACAGGCGCGGCGTCCTCGGCGGCGGGCGGCAGCTAGCGGGAGCCGGGA<br>CGCCGGTGCAGCCGCAGCGCGCGGAGGAACCCGGGTGTGCCGGGAGCTGGGCGGCCA<br>CGTCCGGACGGGACCGAGACCCCTCGTAGCGCATTGCGGCGACCTCGCCTTCCCCGG<br>CCGCGAGCGCGCCGCTGCTTGAAAAGCGCGGAACCCAAGGACTTTTCTCCGGTCCG<br>AGCTCGGGCGCCCCGCAGGGCGCACGGTACCCGTGCTGCAGTCGGGCACGCCGCGG<br>CGCCGGGGCCTCCGCAGGGCGATGGAGCCCGGTCTGCAAGGAAAGTGAGGCGCCGCC<br>GCTGCGTTCTGGAGGAGGGGGGCACAAGGTCTGGAGACCCCGGGTGGCGGACGGGAG<br>CCCTCCCCCCGCCCCGCCTCCGGGGCACCAGCTCCGGCTCCATTGTTCCCGCCCGGG<br>CTGGAGGCGCCGAGCACCGAGCGCCGCCGGGAGTCGAGCGCCGGCCGCGGAGCTCTT<br>GCGACCCCGCCAGGACCCGAACAGAGCCCGGGGGCGGCGGGCCGGAGCCGGGGACGC<br>GGGCACACGCCCGCTCGCACAAGCCACGGCGGACTCTCCCGAGGCGGAACCTCCACG<br>CCGAGCGAGGGTCAGTTTGAAAAGGAGGATCGAGCTCACTGTGGAGTATCCATGGAG<br>ATGTGGAGCCTTGTCACCAACCTCTAACTGCAGAACTGGGATGTGGAGCTGGAAGTG<br>CCTCCTCTTCTGGGCTGTGCTGGTCACAGCCACACTCTGCACCGCTAGGCCGTCCCC<br>GACCTTGCCTGAACAAGATGCTCTCCCCTCCTCGGAGGATGATGATGATGATGATGA<br>CTCCTCTTCAGAGGAGAAAGAAACAGATAACACCAAACCAAACCCCGTAGCTCCATA<br>TTGGACATCCCCAGAAAAGATGGAAAAGAAATTGCATGCAGTGCCGGCTGCCAAGAC<br>AGTGAAGTTCAAATGCCCTTCCAGTGGGACCCCAAACCCCACACTGCGCTGGTTGAA<br>AAATGGCAAAGAATTCAAACCTGACCACAGAATTGGAGGCTACAAGGTCCGTTATGC<br>CACCTGGAGCATCATAATGGACTCTGTGGTGCCCTCTGACAAGGGCAACTACACCTG<br>CATTGTGGAGAATGAGTACGGCAGCATCAACCACACATACCAGCTGGATGTCGTGGA<br>GCGGTCCCCTCACCGGCCCATCCTGCAAGCAGGGTTGCCCGCCAACAAAACAGTGGC<br>CCTGGGTAGCAACGTGGAGTTCATGTGTAAGGTGTACAGTGACCCGCAGCCGCACAT<br>CCAGTGGCTAAAGCACATCGAGGTGAATGGGAGCAAGATTGGCCCAGACAACCTGCC<br>TTATGTCCAGATCTTGAAGACTGCTGGAGTTAATACCACCGACAAAGAGATGGAGGT<br>GCTTCACTTAAGAAATGTCTCCTTTGAGGACGCAGGGGAGTATACGTGCTTGGCGGG<br>TAACTCTATCGGACTCTCCCATCACTCTGCATGGTTGACCGTTCTGGAAGCCCTGGA<br>AGAGAGGCCGGCAGTGATGACCTCGCCCCTGTACCTGGAGATCATCATCTATTGCAC<br>AGGGGCCTTCCTCATCTCCTGCATGGTGGGGTCGGTCATCGTCTACAAGATGAAGAG<br>TGGTACCAAGAAGAGTGACTTCCACAGCCAGATGGCTGTGCACAAGCTGGCCAAGAG<br>CATCCCTCTGCGCAGACAGGTAACAGTGTCTGCTGACTCCAGTGCATCCATGAACTC<br>TGGGGTTCTTCTGGTTCGGCCATCACGGCTCTCCTCCAGTGGGACTCCCATGCTAGC<br>AGGGGTCTCTGAGTATGAGCTTCCCGAAGACCCTCGCTGGGAGCTGCCTCGGGACAG<br>ACTGGTCTTAGGCAAACCCCTGGGAGAGGGCTGCTTTGGGCAGGTGGTGTTGGCAGA<br>GGCTATCGGGCTGGACAAGGACAAACCCAACCGTGTGACCAAAGTGGCTGTGAAGAT<br>GTTGAAGTCGGACGCAACAGAGAAAGACTTGTCAGACCTGATCTCAGAAATGGAGAT<br>GATGAAGATGATCGGGAAGCATAAGAATATCATCAACCTGCTGGGGGCCTGCACGCA<br>GGATGGTCCCTTGTATGTCATCGTGGAGTATGCCTCCAAGGGCAACCTGCGGGAGTA<br>CCTGCAGGCCCGGAGGCCCCCAGGGCTGGAATACTGCTACAACCCCAGCCACAACCC<br>AGAGGAGCAGCTCTCCTCCAAGGACCTGGTGTCCTGCGCCTACCAGGTGGCCCGAGG<br>CATGGAGTATCTGGCCTCCAAGAAGTGCATACACCGAGACCTGGCAGCCAGGAATGT<br>CCTGGTGACAGAGGACAATGTGATGAAGATAGCAGACTTTGGCCTCGCACGGGACAT<br>TCACCACATCGACTACTATAAAAAGACAACCAACGGCCGACTGCCTGTGAAGTGGAT<br>GGCACCCGAGGCATTATTTGACCGGATCTACACCCACCAGAGTGATGTGTGGTCTTT<br>CGGGGTGCTCCTGTGGGAGATCTTCACTCTGGGCGGCTCCCCATACCCCGGTGTGCC<br>TGTGGAGGAACTTTTCAAGCTGCTGAAGGAGGGTCACCGCATGGACAAGCCCAGTAA<br>CTGCACCAACGAGCTGTACATGATGATGCGGGACTGCTGGCATGCAGTGCCCTCACA<br>GAGACCCACCTTCAAGCAGCTGGTGGAAGACCTGGACCGCATCGTGGCCTTGACCTC<br>CAACCAGGAGTACCTGGACCTGTCCATGCCCCTGGACCAGTACTCCCCCAGCTTTCC<br>CGACACCCGGAGCTCTACGTGCTCCTCAGGGGAGGATTCCGTCTTCTCTCATGAGCC<br>GCTGCCCGAGGAGCCCTGCCTGCCCCGACACCCAGCCCAGCTTGCCAATGGCGGACT<br>CAAACGCCGCTGACTGCCACCCACACGCCCTCCCCAGACTCCACCGTCAGCTGTAAC<br>CCTCACCCACAGCCCCTGCTGGGCCCACCACCTGTCCGTCCCTGTCCCCTTTCCTGC<br>TGGCAGGAGCCGGCTGCCTACCAGGGGCCTTCCTGTGTGGCCTGCCTTCACCCCACT<br>CAGCTCACCTCTCCCTCCACCTCCTCTCCACCTGCTGGTGAGAGGTGCAAAGAGGCA<br>GATCTTTGCTGCCAGCCACTTCATCCCCTCCCAGATGTTGGACCAACACCCCTCCCT<br>GCCACCAGGCACTGCCTGGAGGGCAGGGAGTGGGAGCCAATGAACAGGCATGCAAGT<br>GAGAGCTTCCTGAGCTTTCTCCTGTCGGTTTGGTCTGTTTTGCCTTCACCCATAAGC<br>CCCTCGCACTCTGGTGGCAGGTGCCTTGTCCTCAGGGCTACAGCAGTAGGGAGGTCA<br>GTGCTTCGTGCCTCGATTGAAGGTGACCTCTGCCCCAGATAGGTGGTGCCAGTGGCT<br>TATTAATTCCGATACTAGTTTGCTTTGCTGACCAAATGCCTGGTACCAGAGGATGGT<br>GAGGCGAAGGCCAGGTTGGGGGCAGTGTTGTGCCCTGGGGCCCAGCCCCAAACTGG<br>GGGCTCTGTATATAGCTATGAAGAAAACACAAAGTGTATAAATCTGAGTATATATTT<br>ACATGTCTTTTAAAAGGGTCGTTACCAGAGATTTACCCATCGGGTAAGATGCTCCT<br>GGTGGCTGGGAGGCATCAGTTGCTATATATTAAAAACAAAAAAGAAAAAAAAGGAAA<br>ATGTTTTAAAAAGGTCATATATTTTTTGCTACTTTTGCTGTTTTATTTTTTTAAAT<br>TATGTTCTAAACCTATTTTCAGTTTAGGTCCCTCAATAAAATTGCTGCTGCTT |
| SEQ ID NO: 14 | FGFR1 isoform 7 Amino acid sequence | MWSWKCLLFWAVLVTATLCTARPSPTLPEQDALPSSEDDDDDDDSSSEEKETDNTKP<br>NPVAPYWTSPEKMEKKLHAVPAAKTVKFKCPSSGTPNPTLRWLKNGKEFKPDHRIGG<br>YKVRYATWSIIMDSVVPSDKGNYTCIVENEYGSINHTYQLDVVERSPHRPILQAGLP<br>ANKTVALGSNVEFMCKVYSDPQPHIQWLKHIEVNGSKIGPDNLPYVQILKTAGVNTT<br>DKEMEVLHLRNVSFEDAGEYTCLAGNSIGLSHHSAWLTVLEALEERPAVMTSPLYLE<br>IIIYCTGAFLISCMVGSVIVYKMKSGTKKSDFHSQMAVHKLAKSIPLRRQVTVSADS<br>SASMNSGVLLVRPSRLSSSGTPMLAGVSEYELPEDPRWELPRDRLVLGKPLGEGCFG<br>QVVLAEAIGLDKDKPNRVTKVAVKMLKSDATEKDLSDLISEMEMMKMIGKHKNIINL<br>LGACTQDGPLYVIVEYASKGNLREYLQARRPPGLEYCYNPSHNPEEQLSSKDLVSCA<br>YQVARGMEYLASKKCIHRDLAARNVLVTEDNVMKIADFGLARDIHHIDYYKKTTNGR |

TABLE 5-continued

FGFR sequences.

|  |  | LPVKWMAPEALFDRIYTHQSDVWSFGVLLWEIFTLGGSPYPGVPVEELFKLLKEGHR<br>MDKPSNCTNELYMMMRDCWHAVPSQRPTFKQLVEDLDRIVALTSNQEYLDLSMPLDQ<br>YSPSFPDTRSSTCSSGEDSVFSHEPLPEEPCLPRHPAQLANGGLKRR |
|---|---|---|
| SEQ ID<br>NO: 15 | FGFR1<br>isoform 8<br>Nucleic acid<br>sequence | GCTTTGCCCGCCGCAGCCCAGCCGGGGCCGGCGCCTCCCTCCGCTCGCCGCCCGCCC<br>CTTTCACCTCCTGGCTCCCTCCCGGGCGATCCGCGCCCCTTGGGTCTCCCCTTCCCTT<br>CCCTCCGTCCGCGTCTCCTGCGCCCCCTCCCTGCGCTCGTCCCGCCGCTCTTCCCGC<br>CGCCCAACTTTTCCTCCAACTCGCGCTCGGGAGCTGGCGAGGCGGCGGCGGCTCCTC<br>AGGTCAGTTTGAAAAGGAGGATCGAGCTCACTGTGGAGTATCCATGGAGATGTGGAG<br>CCTTGTCACCAACCTCTAACTGCAGAACTGGGATGTGGAGCTGGAAGTGCCTCCTCT<br>TCTGGGCTGTGCTGGTCACAGCCACACTCTGCACCGCTAGGCCGTCCCCGACCTTGC<br>CTGAACAAGCCCAGCCCTGGGGAGCCCCTGTGGAAGTGGAGTCCTTCCTGGTCCACC<br>CCGGTGACCTGCTGCAGCTTCGCTGTCGGCTGCGGGACGATGTGCAGAGCATCAACT<br>GGCTGCGGGACGGGGTGCAGCTGGCGGAAAGCAACCGCACCCGCATCACAGGGGAGG<br>AGGTGGAGGTGCAGGACTCCGTGCCCGCAGACTCCGGCCTCTATGCTTGCGTAACCA<br>GCAGCCCCTCGGGCAGTGACACCACCTACTTCTCCGTCAATGTTTCAGATGCTCTCC<br>CCTCCTCGGAGGATGATGATGATGATGACTCCTCTTCAGAGGAGAAAGAAACAG<br>ATAACACCAAACCAAACCCCGTAGCTCCATATTGGACATCCCCAGAAAAGATGGAAA<br>AGAAATTGCATGCAGTGCCGGCTGCCAAGACAGTGAAGTTCAAATGCCCTTCCAGTG<br>GGACCCCAAACCCCACACTGCGCTGGTTGAAAAATGGCAAAGAATTCAAACCTGACC<br>ACAGAATTGGAGGCTACAAGGTCCGTTATGCCACCTGGAGCATCATAATGGACTCTG<br>TGGTGCCCTCTGACAAGGGCAACTACACCTGCATTGTGGAGAATGAGTACGGCAGCA<br>TCAACCACACATACCAGCTGGATGTCGTGGAGCGGTCCCCTCACCGGCCCATCCTGC<br>AAGCAGGGTTGCCCGCCAACAAAACAGTGGCCCTGGGTAGCAACGTGGAGTTCATGT<br>GTAAGGTGTACAGTGACCCGCAGCCGCACATCCAGTGGCTAAAGCACATCGAGGTGA<br>ATGGGAGCAAGATTGGCCCAGACAACCTGCCTTATGTCCAGATCTTGAAGACTGCTG<br>GAGTTAATACCACCGACAAAGAATGGAGGTGCTTCACTTAAGAAATGTCTCCTTTG<br>AGGACGCAGGGGAGTATACGTGCTTGGCGGGTAACTCTATCGGACTCTCCCATCACT<br>CTGCATGGTTGACCGTTCTGGAAGCCCTGGAAGAGAGGCCGGCAGTGATGACCTCGC<br>CCCTGTACCTGGAGATCATCATCTATTGCACAGGGGCCTTCCTCATCCTGCATGG<br>TGGGGTCGGTCATCGTCTACAAGATGAAGAGTGGTACCAAGAAGAGTGACTTCCACA<br>GCCAGATGGCTGTGCACAAGCTGGCCAAGAGCATCCCTCTGCGCAGACAGGTAACAG<br>TGTCTGCTGACTCCAGTGCATCCATGAACTCTGGGGTTCTTCTGGTTCGGCCATCAC<br>GGCTCTCCTCCAGTGGGACTCCCATGCTAGCAGGGGTCTCTGAGTATGAGCTTCCCG<br>AAGACCCTCGCTGGGAGCTGCCTCGGGACAGACTGGTCTTAGGCAAACCCCTGGGAG<br>AGGGCTGCTTTGGGCAGGTGGTGTTGGCAGAGGCTATCGGGCTGGACAAGGACAAAC<br>CCAACCGTGTGACCAAAGTGGCTGTGAAGATGTTGAAGTCGGACGCAACAGAGAAAG<br>ACTTGTCAGACCTGATCTCAGAAATGGAGATGATGAAGATGATCGGGAAGCATAAGA<br>ATATCATCAACCTGCTGGGGGCCTGCACGCAGGATGGTCCCTTGTATGTCATCGTGG<br>AGTATGCCTCCAAGGGCAACCTGCGGGAGTACCTGCAGGCCCGGAGGCCCCCAGGGC<br>TGGAATACTGCTACAACCCCAGCCACAACCCAGAGGAGCAGCTCTCCTCCAAGGACC<br>TGGTGTCCTGCGCCTACCAGGTGGCCCGAGGCATGGAGTATCTGGCCTCCAAGAAGT<br>GCATACACCGAGACCTGGCAGCCAGGAATGTCCTGGTGACAGAGGACAATGTGATGA<br>AGATAGCAGACTTTGGCCTCGCACGGGACATTCACCACATCGACTACTATAAAAAGA<br>CAACCAACGGCCGACTGCCTGTGAAGTGGATGGCACCCGAGGCATTATTTGACCGGA<br>TCTACACCCACCAGAGTGATGTGTGGTCTTTCGGGGTGCTCCTGTGGGAGATCTTCA<br>CTCTGGGCGGCTCCCCATACCCCGGTGTGCCTGTGGAGGAACTTTTCAAGCTGCTGA<br>AGGAGGGTCACCGCATGGACAAGCCCAGTAACTGCACCAACGAGCTGTACATGATGA<br>TGCGGGACTGCTGGCATGCAGTGCCCTCACAGAGACCCACCTTCAAGCAGCTGGTGG<br>AAGACCTGGACCGCATCGTGGCCTTGACCTCCAACCAGGAGTACCTGGACCTGTCCA<br>TGCCCCTGGACCAGTACTCCCCCAGCTTTCCCGACACCCGGAGCTCTACGTGCTCCT<br>CAGGGGAGGATTCCGTCTTCTCTCATGAGCCGCTGCCCGAGGAGCCCTGCCTGCCCC<br>GACACCCAGCCCAGCTTGCCAATGGCGGACTCAAACGCCGCTGACTGCCACCCACAC<br>GCCCTCCCCAGACTCCACCGTCAGCTGTAACCCTCACCCACAGCCCCTGCTGGGCCC<br>ACCACCTGTCCGTCCCTGTCCCCTTCCTGCTGGCAGGAGCCGGCTGCCTACCAGGG<br>GCCTTCCTGTGTGGCCTGCCTTCACCCCACTCAGCTCACCTCTCCCTCCACCTCCTC<br>TCCACCTGCTGGTGAGAGGTGCAAAGAGGCAGATCTTTGCTGCCAGCCACTTCATCC<br>CCTCCCAGATGTTGGACCAACACCCCTCCCTGCCACCAGGCACTGCCTGGAGGGCAG<br>GGAGTGGGAGCCAATGAACAGGCATGCAAGTGAGAGCTTCCTGAGCTTTCTCCTGTC<br>GGTTTGGTCTGTTTTGCCTTCACCCATAAGCCCCTCGCACTCTGGTGGCAGGTGCCT<br>TGTCCTCAGGGCTACAGCAGTAGGGAGGTCAGTGCTTCGTGCCTCGATTGAAGGTGA<br>CCTCTGCCCCAGATAGGTGGTGCCAGTGGCTTATTAATTCCGATACTAGTTTGCTTT<br>GCTGACCAAATGCCTGGTACCAGAGGATGGTGAGGCGAAGGCCAGGTTGGGGGCAGT<br>GTTGTGGCCCTGGGGCCCAGCCCCAAACTGGGGCTCTGTATATAGCTATGAAGAAA<br>ACACAAAGTGTATAAATCTGAGTATATATTTACATGTCTTTTTAAAAGGGTCGTTAC<br>CAGAGATTTACCCATCGGGTAAGATGCTCCTGGTGGCTGGGAGGCATCAGTTGCTAT<br>ATATTAAAACAAAAAGAAAAAAAGGAAATGTTTTAAAAAGGTCATATATTTT<br>TTGCTACTTTTGCTGTTTTATTTTTTAAATTATGTTCTAAACCTATTTTCAGTTTA<br>GGTCCCTCAATAAAAATTGCTGCTGCTTCATT |
| SEQ ID<br>NO: 16 | FGFR1<br>isoform 8<br>Amino acid<br>sequence | MWSWKCLLFWAVLVTATLCTARPSPTLPEQAQPWGAPVEVESFLVHPGDLLQLRCRL<br>RDDVQSINWLRDGVQLAESNRTRITGEEVEVQDSVPADSGLYACVTSSPSGSDTTYF<br>SVNVSDALPSSEDDDDDDSSSEEKETDNTKPNPVAPYWTSPEKMEKKLHAVPAAKT<br>VKFKCPSSGTPNPTLRWLKNGKEFKPDHRIGGYKVRYATWSIIMDSVVPSDKGNYTC<br>IVENEYGSINHTYQLDVVERSPHRPILQAGLPANKTVALGSNVEFMCKVYSDPQPHI<br>QWLKHIEVNGSKIGPDNLPYVQILKTAGVNTTDKEMEVLHLRNVSFEDAGEYTCLAG<br>NSIGLSHHSAWLTVLEALEERPAVMTSPLYLEIIIYCTGAFLISCMVGSVIVYKMKS<br>GTKKSDFHSQMAVHKLAKSIPLRRQVTVSADSSASMNSGVLLVRPSRLSSSGTPMLA |

TABLE 5-continued

FGFR sequences.

|  |  |  |
|---|---|---|
|  |  | GVSEYELPEDPRWELPRDRLVLGKPLGEGCFGQVVLAEAIGLDKDKPNRVTKVAVKM<br>LKSDATEKDLSDLISEMEMMKMIGKHKNIINLLGACTQDGPLYVIVEYASKGNLREY<br>LQARRPPGLEYCYNPSHNPEEQLSSKDLVSCAYQVARGMEYLASKKCIHRDLAARNV<br>LVTEDNVMKIADFGLARDIHHIDYYKKTTNGRLPVKWMAPEALFDRIYTHQSDVWSF<br>GVLLWEIFTLGGSPYPGVPVEELFKLLKEGHRMDKPSNCTNELYMMMRDCWHAVPSQ<br>RPTFKQLVEDLDRIVALTSNQEYLDLSMPLDQYSPSFPDTRSSTCSSGEDSVFSHEP<br>LPEEPCLRHPAQLANGGLKRR |
| SEQ ID<br>NO: 17 | FGFR1<br>isoform 9<br>Nucleic acid<br>sequence | AACTTTTCCTCCAACTCGCGCTCGGGAGCTGGCGAGGCGGCGGCGGCTCCTCAAAGT<br>GGGAGAGCTTCAAGGTCACGTGGTCCGTCCAGCCCCTGCTATCTCACCAGACACTGT<br>CCACCCTGTATGTTGGATCAGTACTCCAGTGAGAAGACAGCAGGCACTTTCACCCAT<br>GCAGCCCATTCAGTCTTCATAACCACCTGTGATGGAGGCAAGGGTCAGTTTGAAAAG<br>GAGGATCGAGCTCACTGTGGAGTATCCATGGAGATGTGGAGCCTTGTCACCAACCTC<br>TAACTGCAGAACTGGGATGTGGAGCTGGAAGTGCCTCCTCTTCTGGGCTGTGCTGGT<br>CACAGCCACACTCTGCACCGCTAGGCCGTCCCCGACCTTGCCTGAACAAGCCCAGCC<br>CTGGGGAGCCCCTGTGGAAGTGGAGTCCTTCCTGGTCCACCCCGGTGACCTGCTGCA<br>GCTTCGCTGTCGGCTGCGGGACGATGTGCAGAGCATCAACTGGCTGCGGGACGGGGT<br>GCAGCTGGCGGAAAGCAACCGCACCCGCATCACAGGGGAGGAGGTGGAGGTGCAGGA<br>CTCCGTGCCCGCAGACTCCGGCCTCTATGCTTGCGTAACCAGCAGCCCCTCGGGCAG<br>TGACACCACCTACTTCTCCGTCAATGTTTCAGATGCTCTCCCCTCCTCGGAGGATGA<br>TGATGATGATGACTCCTCTTCAGAGGAGAAAGAAACAGATAACACCAAACCCAAA<br>CCCCGTAGCTCCATATTGGACATCCCCAGAAAAGATGGAAAAGAAATTGCATGCAGT<br>GCCGGCTGCCAAGACAGTGAAGTTCAAATGCCCTTCCAGTGGGACCCCAAACCCCAC<br>ACTGCGCTGGTTGAAAAATGGCAAAGAATTCAAACCTGACCACAGAATTGGAGGCTA<br>CAAGGTCCGTTATGCCACCTGGAGCATCATAATGGACTCTGTGGTGCCCTCTGACAA<br>GGGCAACTACACCTGCATTGTGGAGAATGAGTACGGCAGCATCAACCACACATACCA<br>GCTGGATGTCGTGGAGCGGTCCCCTCACCGGCCCATCCTGCAAGCAGGGTTGCCCGC<br>CAACAAAACAGTGGCCCTGGGTAGCAACGTGGAGTTCATGTGTAAGGTGTACAGTGA<br>CCCGCAGCCGCACATCCAGTGGCTAAAGCACATCGAGGTGAATGGGAGCAAGATTGG<br>CCCAGACAACCTGCCTTATGTCCAGATCTTGAAGACTGCTGGAGTTAATACCACCGA<br>CAAAGAGATGGAGGTGCTTCACTTAAGAAATGTCTCCTTTGAGGACGCAGGGGAGTA<br>TACGTGCTTGGCGGGTAACTCTATCGGACTCTCCCATCACTCTGCATGGTTGACCGT<br>TCTGGAAGCCCTGGAAGAGAGGCCGGCAGTGATGACCTCGCCCCTGTACCTGGAGAT<br>CATCATCTATTGCACAGGGGCCTTCCTCATCCTGCATGGTGGGGTCGGTCATCGT<br>CTACAAGATGAAGAGTGGTACCAAGAAGAGTGACTTCCACAGCCAGATGGCTGTGCA<br>CAAGCTGGCCAAGAGCATCCCTCTGCGCAGACAGGTAACAGTGTCTGCTGACTCCAA<br>TGCATCCATGAACTCTGGGGTTCTTCTGGTTCGGCCATCACGGCTCTCCTCCAGTGG<br>GACTCCCATGCTAGCAGGGGTCTCTGAGTATGAGCTTCCCGAAGACCCTCGCTGGGA<br>GCTGCCTCGGGACAGACTGGTCTTAGGCAAACCCCTGGGAGAGGGCTGCTTTGGGCA<br>GGTGGTGTTGGCAGAGGCTATCGGGCTGGACAAGGACAAACCCAACCGTGTGACCAA<br>AGTGGCTGTGAAGATGTTGAAGTCGGACGCAACAGAGAAAGACTTGTCAGACCTGAT<br>CTCAGAAATGGAGATGATGAAGATGATCGGGAAGCATAAGAATATCATCAACCTGCT<br>GGGGGCCTGCACGCAGGATGGTCCCTTGTATGTCATCGTGGAGTATGCCTCCAAGGG<br>CAACCTGCGGGAGTACCTGCAGGCCCGGAGGCCCCCAGGGCTGGAATACTGCTACAA<br>CCCCAGCCACAACCCAGAGGAGCAGCTCTCCTCCAAGGACCTGGTGTCCTGCGCCTA<br>CCAGGTGGCCCGAGGCATGGAGTATCTGGCCTCCAAGAAGTGCATACACCGAGACCT<br>GGCAGCCAGGAATGTCCTGGTGACAGAGGACAATGTGATGAAGATAGCAGACTTTGG<br>CCTCGCACGGGACATTCACCACATCGACTACTATAAAAAGACAACCAACGGCCGACT<br>GCCTGTGAAGTGGATGGCACCCGAGGCATTATTTGACCGGATCTACACCCACCAGAG<br>TGATGTGTGGTCTTTCGGGGTTGCTCCTGTGGGAGATCTTCACTCTGGGCGGCTCCCC<br>ATACCCCGGTGTGCCTGTGGAGGAACTTTTCAAGCTGCTGAAGGAGGGTCACCGCAT<br>GGACAAGCCCAGTAACTGCACCAACGAGCTGTACATGATGATGCGGGACTGCTGGCA<br>TGCAGTGCCCTCACAGAGACCCACCTTCAAGCAGCTGGTGGAAGACCTGGACCGCAT<br>CGTGGCCTTGACCTCCAACCAGGAGTACCTGGACCTGTCCATGCCCCTGGACCAGTA<br>CTCCCCCAGCTTTCCCGACACCCGGAGCTCTACGTGCTCCTCAGGGGAGGATTCCGT<br>CTTCTCTCATGAGCCGCTGCCCGAGGAGCCCTGCCTGCCCCGACACCCAGCCCAGCT<br>TGCCAATGGCGGACTCAAACGCCGCTGACTGCCACCCACACGCCCTCCCCAGACTCC<br>ACCGTCAGCTGTAACCCTCACCCACAGCCCCTGCTGGGCCCACCACCTGTCCGTCCC<br>TGTCCCCTTTCCTGCTGGCA |
| SEQ ID<br>NO: 18 | FGFR1<br>isoform 9<br>Amino acid<br>sequence | MWSWKCLLFWAVLVTATLCTARPSPTLPEQAQPWGAPVEVESFLVHPGDLLQLRCRL<br>RDDVQSINWLRDGVQLAESNRTRITGEEVEVQDSVPADSGLYACVTSSPSGSDTTYF<br>SVNVSDALPSSEDDDDDDSSSEEKETDNTKPNPVAPYWTSPEKMEKKLHAVPAAKT<br>VKFKCPSSGTNPTLRWLKNGKEFKPDHRIGGYKVRYATWSIIMDSVVPSDKGNYTC<br>IVENEYGSINHTYQLDVVERSPHRPILQAGLPANKTVALGSNVEFMCKVYSDPQPHI<br>QWLKHIEVNGSKIGPDNLPYVQILKTAGVNTTDKEMEVLHLRNVSFEDAGEYTCLAG<br>NSIGLSHHSAWLTVLEALEERPAVMTSPLYLEIIIYCTGAFLISCMVGSVIVYKMKS<br>GTKKSDFHSQMAVHKLAKSIPLRRQVTVSADSSASMNSGVLLVRPSRLSSSGTPMLA<br>GVSEYELPEDPRWELPRDRLVLGKPLGEGCFGQVVLAEAIGLDKDKPNRVTKVAVKM<br>LKSDATEKDLSDLISEMEMMKMIGKHKNIINLLGACTQDGPLYVIVEYASKGNLREY<br>LQARRPPGLEYCYNPSHNPEEQLSSKDLVSCAYQVARGMEYLASKKCIHRDLAARNV<br>LVTEDNVMKIADFGLARDIHHIDYYKKTTNGRLPVKWMAPEALFDRIYTHQSDVWSF<br>GVLLWEIFTLGGSPYPGVPVEELFKLLKEGHRMDKPSNCTNELYMMMRDCWHAVPSQ<br>RPTFKQLVEDLDRIVALTSNQEYLDLSMPLDQYSPSFPDTRSSTCSSGEDSVFSHEP<br>LPEEPCLRHPAQLANGGLKRR |

TABLE 5-continued

| | | |
|---|---|---|
| | FGFR sequences. | |
| SEQ ID NO: 19 | FGFR2 isoform 1 Nucleic acid sequence | GGCGGCGGCTGGAGGAGAGCGCGGTGGAGAGCCGAGCGGGCGGGCGGCGGGTGCGGA GCGGGCGAGGGAGCGCGCGCGGCCGCCACAAAGCTCGGGCGCCGCGGGGCTGCATGC GGCGTACCTGGCCCGGCGCGGCGACTGCTCTCCGGGCTGGCGGGGGCCGGCCGCGAG CCCCGGGGGCCCCGAGGCCGCAGCTTGCCTGCGCGCTCTGAGCCTTCGCAACTCGCG AGCAAAGTTTGGTGGAGGCAACGCCAAGCCTGAGTCCTTTCTTCCTCTCGTTCCCCA AATCCGAGGGCAGCCCGCGGGCGTCATGCCCGCGCTCCTCCGCAGCCTGGGGTACGC GTGAAGCCCGGGGAGGCTTGGCGCCGGCGAAGACCCAAGGACCACTCTTCTGCGTTTG GAGTTGCTCCCCGCAACCCCGGGCTCGTCGCTTTCTCCATCCCGACCCACGCGGGGC GCGGGGACAACACAGGTCGCGGAGGAGCGTTGCCATTCAAGTGACTGCAGCAGCAGC GGCAGCGCCTCGGTTCCTGAGCCCACCGCAGGCTGAAGGCATTGCGCGTAGTCCATG CCCGTAGAGGAAGTGTGCAGATGGGATTAACGTCCACATGGAGATATGGAAGAGGAC CGGGGATTGGTACCGTAACCATGGTCAGCTGGGGTCGTTTCATCTGCCTGGTCGTGG TCACCATGGCAACCTTGTCCCTGGCCCGGCCCTCCTTCAGTTTAGTTGAGGATACCA CATTAGAGCCAGAAGATGCCATCTCATCCGGAGATGATGAGGATGACACCGATGGTG CGGAAGATTTTGTCAGTGAGAACAGTAACAACAAGAGAGCACCATACTGGACCAACA CAGAAAAGATGGAAAAGCGGCTCCATGCTGTGCCTGCGGCCAACACTGTCAAGTTTC GCTGCCCAGCCGGGGGGAACCCAATGCCAACCATGCGGTGGCTGAAAAACGGGAAGG AGTTTAAGCAGGAGCATCGCATTGGAGGCTACAAGGTACGAAACCAGCACTGGAGCC TCATTATGGAAAGTGTGGTCCCATCTGACAAGGGAAATTATACCTGTGTAGTGGAGA ATGAATACGGGTCCATCAATCACACGTACCACCTGGATGTTGTGGAGCGATCGCCTC ACCGGCCCATCCTCCAAGCCGGACTGCCGGCAAATGCCTCCACAGTGGTCGGAGGAG ACGTAGAGTTTGTCTGCAAGGTTTACAGTGATGCCCAGCCCCACATCCAGTGGATCA AGCACGTGGAAAAGAACGGCAGTAAATACGGGCCCGACGGGCTGCCCTACCTCAAGG TTCTCAAGGCCGCCGGTGTTAACACCACGGACAAAGAGATTGAGGTTCTCTATATTC GGAATGTAACTTTTGAGGACGCTGGGGAATATACGTGCTTGGCGGGTAATTCTATTG GGATATCCTTTCACTCTGCATGGTTGACAGTTCTGCCAGCGCCTGGAAGAGAAAAGG AGATTACAGCTTCCCCAGACTACCTGGAGATAGCCATTTACTGCATAGGGGTCTTCT TAATCGCCTGTATGGTGGTAACAGTCATCCTGTGCCGAATGAAGAACACGACCAAGA AGCCAGACTTCAGCAGCCAGCCGGCTGTGCACAAGCTGACCAAACGTATCCCCCTGC GGAGACAGGTAACAGTTTCGGCTGAGTCCAGCTCCTCCATGAACTCCAACACCCCGC TGGTGAGGATAACAACACGCCTCTCTTCAACGGCAGACACCCCCATGCTGGCAGGGG TCTCCGAGTATGAACTTCCAGAGGACCCAAAATGGGAGTTTCCAAGAGATAAGCTGA CACTGGGCAAGCCCCTGGGAGAAGGTTGCTTTGGGCAAGTGGTCATGGCGGAAGCAG TGGGAATTGACAAAGACAAGCCCAAGGAGGCGGTCACCGTGGCCGTGAAGATGTTGA AAGATGATGCCACAGAGAAAGACCTTTCTGATCTGGTGTCAGAGATGGAGATGATGA AGATGATTGGGAAACACAAGAATATCATAAATCTTCTTGGAGCCTGCACACAGGATG GGCCTCTCTATGTCATAGTTGAGTATGCCTCTAAAGGCAACCTCCGAGAATACCTCC GAGCCCGGAGGCCACCCGGGATGGAGTACTCCTATGACATTAACCGTGTTCCTGAGG AGCAGATGACCTTCAAGGACTTGGTGTCATGCACCTACCAGCTGGCCAGAGGCATGG AGTACTTGGCTTCCCAAAAATGTATTCATCGAGATTTAGCAGCCAGAAATGTTTTGG TAACAGAAAACAATGTGATGAAAATAGCAGACTTTGGACTCGCCAGAGATATCAACA ATATAGACTATTACAAAAAGACCACCAATGGGCGGCTTCCAGTCAAGTGGATGGCTC CAGAAGCCCTGTTTGATAGAGTATACACTCATCAGAGTGATGTCTGGTCCTTCGGGG TGTTAATGTGGGAGATCTTCACTTTAGGGGGCTCGCCCTACCCCAGGGATTCCCGTGG AGGAACTTTTTAAGCTGCTGAAGGAAGGACACAGAATGGATAAGCCAGCCAACTGCA CCAACGAACTGTACATGATGATGAGGGACTGTTGGCATGCAGTGCCCTCCCAGAGAC CAACGTTCAAGCAGTTGGTAGAAGACTTGGATCGAATTCTCACTCTCACAACCAATG AGGAATACTTGGACCTCAGCCAACCTCTCGAACAGTATTCACCTAGTTACCCTGACA CAAGAAGTTCTTGTTCTTCAGGAGATGATTCTGTTTTTTCTCCAGACCCCATGCCTT ACGAACCATGCCTTCCTCAGTATCCACACATAAACGGCAGTGTTAAAACATGAATGA CTGTGTCTGCCTGTCCCAAACAGGACAGCACTGGGAACCTAGCTACACTGAGCAGG GAGACCATGCCTCCCAGAGCTTGTTGTCTCCACTTGTATATATGGATCAGAGGAGTA AATAATTGGAAAAGTAATCAGCATATGTGTAAAGATTTATACAGTTGAAAACTTGTA ATCTTCCCCAGGAGGAGAAGAAGGTTTCTGGAGCAGTGGACTGCCACAAGCCACCAT GTAACCCCTCTCACCTGCCGTGCGTACTGGCTGTGGACCAGTAGGACTCAAGGTGGA CGTGCGTTCTGCCTTCCTTGTTAATTTGTAATAATTGGAGAAGATTTATGTCAGCA CACACTTACAGAGCACAAATGCAGTATATAGGTGCTGGATGTATGTAAATATATTCA AATTATGTATAAATATATTATATATTTACAAGGAGTTATTTTTGTATTGATTTT AAATGGATGTCCCAATGCACCTAGAAAATTGGTCTCTCTTTTTTTAATAGCTATTTG CTAAATGCTGTTCTTACACATAATTTCTTAATTTTCACCGAGCAGAGGTGGAAAAAT ACTTTTGCTTTCAGGGAAAATGGTATAACGTTAATTTATTAATAAATTGGTAATATA CAAAACAATTAATCATTTATAGTTTTTTTTGTAATTTAAGTGGCATTTCTATGCAGG CAGCACAGCAGACTAGTTAATCTATTGCTTGGACTTAACTAGTTATCAGATCCTTTG AAAAGAGAATATTTACAATATATGACTAATTTGGGGAAAATGAAGTTTTGATTTATT TGTGTTTAAATGCTGCTGTCAGACGATTGTTCTTAGACCTCCTAAATGCCCCATATT AAAAGAACTCATTCATAGGAAGGTGTTTCATTTTGGTGTGCAACCCTGTCATTACGT CAACGCAACGTCTAACTGGACTTCCCAAGATAAATGGTACCAGCGTCCTCTTAAAAG ATGCCTTAATCCATTCCTTGAGGACAGACCTTAGTTGAAATGATAGCAGAATGTGCT TCTCTCTGGCAGCTGGCCTTCTGCTTCTGAGTTGCACATTAATCAGATTAGCCTGTA TTCTCTTCAGTGAATTTTGATAATGGCTTCCAGACTCTTTGGCGTTGGAGACGCCTG TTAGGATCTTCAAGTCCCATCATAGAAAATTGAAACACAGAGTTGTTCTGCTGATAG TTTTGGGGATACGTCCATCTTTTTAAGGGATTGCTTTCATCTAATTCTGGCAGGACC TCACCAAAAGATCCAGCCTCATACCTACATCAGACAAAATATCGCCGTTGTTCCTTC TGTACTAAAGTATTGTGTTTTGCTTTGGAAACACCCACTCACTTTGCAATAGCCGTG CAAGATGAATGCAGATTACACTGATCTTATGTGTTACAAAATTGGAGAAGTATTTA ATAAAACCTGTTAATTTTTATACTGACAATAAAATGTTTCTACAGATATTAATGTT AACAAGACAAAATAAATGTCACGCAACTTATTTTTTT |

TABLE 5-continued

FGFR sequences.

| SEQ ID NO: 20 | FGFR2 isoform 1 Amino acid sequence | MVSWGRFICLVVVTMATLSLARPSFSLVEDTTLEPEDAISSGDDEDDTDGAEDFVSE NSNNKRAPYWTNTEKMEKRLHAVPAANTVKFRCPAGGNPMPTMRWLKNGKEFKQEHR IGGYKVRNQHWSLIMESVVPSDKGNYTCVVENEYGSINHTYHLDVVERSPHRPILQA GLPANASTVVGGDVEFVCKVYSDAQPHIQWIKHVEKNGSKYGPDGLPYLKVLKAAGV NTTDKEIEVLYIRNVTFEDAGEYTCLAGNSIGISFHSAWLTVLPAPGREKEITASPD YLEIAIYCIGVFLIACMVVTVILCRMKNTTKKPDFSSQPAVMHKLTKRIPLRRQVTVS AESSSSMNSNTPLVRITTRLSSTADTPMLAGVSEYELPEDPKWEFPRDKLTLGKPLG EGCFGQVVMAEAVGIDKDKPKEAVTVAVKMLKDDATEKDLSDLVSEMEMMKMIGKHK NIINLLGACTQDGPLYVIVEYASKGNLREYLRARRPPGMEYSYDINRVPEEQMTFKD LVSCTYQLARGMEYLASQKCIHRDLAARNVLVTENNVMKIADFGLARDINNIDYYKK TTNGRLPVKWMAPEALFDRVYTHQSDVWSFGVLMWEIFTLGGSPYPGIPVEELFKLL KEGHRMDKPANCTNELYMMMRDCWHAVPSQRPTFKQLVEDLDRILTLTTNEEYLDLS QPLEQYSPSYPDTRSSCSSGDDSVFSPDPMPYEPCLPQYPHINGSVKT |
| --- | --- | --- |
| SEQ ID NO: 21 | FGFR2 isoform 2 Nucleic acid sequence | CCCAAGGACCACTCTTCTGCGTTTGGAGTTGCTCCCCGCAACCCCGGGCTCGTCGCT TTCTCCATCCCGACCCACGCGGGGCGCGGGGACAACACAGGTCGCGGAGGAGCGTTG CCATTCAAGTGACTGCAGCAGCAGCGGCAGCGCCTCGGTTCCTGAGCCCACCGCAGG CTGAAGGCATTGCGCGTAGTCCATGCCCGTAGAGGAAGTGTGCAGATGGGATTAACG TCCACATGGAGATATGGAAGAGGACCGGGGATTGGTACCGTAACCATGGTCAGCTGG GGTCGTTTCATCTGCCTGGTCGTGGTCACCATGGCAACCTTGTCCCTGGCCCGGCCC TCCTTCAGTTTAGTTGAGGATACCACATTAGAGCCAGAAGAGCCACCAACCAAATAC CAAATCTCTCAACCAGAAGTGTACGTGGCTGCGCCAGGGGAGTCGCTAGAGGTGCGC TGCCTGTTGAAAGATGCCGCCGTGATCAGTTGGACTAAGGATGGGGTGCACTTGGGG CCCAACAATAGGACAGTGCTTATTGGGGAGTACTTGCAGATAAAGGGCGCCACGCCT AGAGACTCCGGCCTCTATGCTTGTACTGCCAGTAGGACTGTAGACAGTGAAACTTGG TACTTCATGGTGAATGTCACAGATGCCATCTCATCCGGAGATGATGAGGATGACACC GATGGTGCGGAAGATTTTGTCAGTGAGAACAGTAACAACAAGAGAGCACCATACTGG ACCAACACAGAAAAGATGGAAAAGCGGCTCCATGCTGTGCCTGCGGCCAACACTGTC AAGTTTCGCTGCCCAGCCGGGGGGAACCCAATGCCAACCATGCGGTGGCTGAAAAAC GGGAAGGAGTTTAAGCAGGAGCATCGCATTGGAGGCTACAAGGTACGAAACCAGCAC TGGAGCCTCATTATGGAAAGTGTGGTCCCATCTGACAAGGGAAATTATACCTGTGTA GTGGAGAATGAATACGGGTCCATCAATCACACGTACCACCTGGATGTTGTGGAGCGA TCGCCTCACCGGCCCATCCTCCAAGCCGGACTGCCGGCAAATGCCTCCACAGTGGTC GGAGGAGACGTAGAGTTTGTCTGCAAGGTTTACAGTGATGCCCAGCCCCACATCCAG TGGATCAAGCACGTGGAAAAGAACGGCAGTAAATACGGGCCCGACGGGCTGCCCTAC CTCAAGGTTCTCAAGGCCGCCGGTGTTAACACCACGGACAAAGAGATTGAGGTTCTC TATATTCGGAATGTAACTTTTGAGGACGCTGGGGAATATACGTGCTTGGCGGGTAAT TCTATTGGGATATCCTTTCACTCTGCATGGTTGACAGTTCTGCCAGCGCCTGGAAGA GAAAAGGAGATTACAGCTTCCCAGACTACCTGGAGATAGCCATTTACTGCATAGGG GTCTTCTTAATCGCCTGTATGGTGGTAACAGTCATCCTGTGCCGAATGAAGAACACG ACCAAGAAGCCAGACTTCAGCAGCCAGCCGGCTGTGCACAAGCTGACCAAACGTATC CCCCTGCGGAGACAGGTAACAGTTTCGGCTGAGTCCAGCTCCTCCATGAACTCCAAC ACCCCGCTGGTGAGGATAACAACACGCCTCTCTTCAACGGCAGACACCCCCATGCTG GCAGGGGTCTCCGAGTATGAACTTCCAGAGGACCCAAAATGGGAGTTTCCAAGAGAT AAGCTGACACTGGGCAAGCCCCTGGGAGAAGGTTGCTTTGGGCAAGTGGTCATGGCG GAAGCAGTGGGAATTGACAAAGACAAGCCCAAGGAGGCGGTCACCGTGGCCGTGAAG ATGTTGAAAGATGATGCCACAGAGAAAGACCTTTCTGATCTGGTGTCAGAGATGGAG ATGATGAAGATGATTGGGAAACACAAGAATATCATAAATCTTCTTGGAGCCTGCACA CAGGATGGGCCTCTCTATGTCATAGTTGAGTATGCCTCTAAAGGCAACCTCCGAGAA TACCTCCGAGCCCGGAGGCCACCCGGGATGGAGTACTCCTATGACATTAACCGTGTT CCTGAGGAGCAGATGACCTTCAAGGACTTGGTGTCATGCACCTACCAGCTGGCCAGA GGCATGGAGTACTTGGCTTCCCAAAAATGTATTCATCGAGATTTAGCAGCCAGAAAT GTTTTGGTAACAGAAAACAATGTGATGAAAATAGCAGACTTTGGACTCGCCAGAGAT ATCAACAATATAGACTATTACAAAAAGACCACCAATGGGCGGCTTCCAGTCAAGTGG ATGGCTCCAGAAGCCCTGTTTGATAGAGTATACACTCATCAGAGTGATGTCTGGTCC TTCGGGGTGTTAATGTGGGAGATCTTCACTTTAGGGGGCTCGCCCTACCCCAGGGATT CCCGTGGAGGAACTTTTTAAGCTGCTGAAGGAAGGACACAGAATGGATAAGCCAGCC AACTGCACCAACGAACTGTACATGATGATGAGGGACTGTTGGCATGCAGTGCCCTCC CAGAGACCAACGTTCAAGCAGTTGGTAGAAGACTTGGATCGAATTCTCACTCTCACA ACCAATGAGGAATACTTGGACCTCAGCCAACCTCTCGAACAGTATTCACCTAGTTAC CCTGACACAAGAAGTTCTTGTTCTTCAGGAGATGATTCTGTTTTTTCTCCAGACCCC ATGCCTTACGAACCATGCCTTCCTCAGTATCCACACATAAACGGCAGTGTTAAAACA TGAATGACTGTGTCTGCCTGTCCCCAAACAGGACAGCACTGGGAACCTAGCTACACT GAGCAGGGAGACCATGCCTCCCAGAGCTTGTTGTCTCCACTTGTATATATGGATCAG AGGAGTAAATAATTGGAAAGTAATCAGCATATGTGTAAAGATTTATACAGTTGAAA ACTTGTAATCTTCCCCAGGAGGAGAAGAAGGTTTCTGGAGCAGTGGACTGCCACAAG CCACCATGTAACCCCTCTCACCTGCCGTGCGTACTGGCTGTGACCAGTAGGACTCA AGGTGGACGTGCGTTCTGCCTTCCTTGTTAATTTTGTAATAATTGGAGAAGATTTAT GTCAGCACACACTTACAGAGCACAAATGCAGTATATAGGTGCTGGATGTATGTAAAT ATATTCAAATTATGTATAAATATATATTATATATTTACAAGGAGTTATTTTTTGTAT TGATTTTAAATGGATGTCCCAATGCACCTAGAAAATTGGTCTCTCTTTTTTTAATAG CTATTTGCTAAATGCTGTTCTTACACATAATTTCTTAATTTTCACCGAGCAGAGGTG GAAAAATACTTTTGCTTTCAGGGAAAATGGTATAACGTTAATTTATTAATAAATTGG TAATATACAAAACAATTAATCATTTATAGTTTTTTTTGTAATTTAAGTGGCATTTCT ATGCAGGCAGCACAGCAGACTAGTTAATCTATTGCTTGGACTTAACTAGTTATCAGA TCCTTTGAAAAGAGAATATTTACAATATATGACTAATTTGGGGAAAATGAAGTTTTG ATTTATTTGTGTTTAAATGCTGCTGTCAGACGATTGTTCTTAGACCTCCTAAATGCC CCATATTAAAAGAACTCATTCATAGGAAGGTGTTTCATTTTGGTGTGCAACCCTGTC |

TABLE 5-continued

FGFR sequences.

|  |  |  |
|---|---|---|
|  |  | ATTACGTCAACGCAACGTCTAACTGGACTTCCCAAGATAAATGGTACCAGCGTCCTC<br>TTAAAAGATGCCTTAATCCATTCCTTGAGGACAGACCTTAGTTGAAATGATAGCAGA<br>ATGTGCTTCTCTCTGGCAGCTGGCCTTCTGCTTCTGAGTTGCACATTAATCAGATTA<br>GCCTGTATTCTCTTCAGTGAATTTTGATAATGGCTTCCAGACTCTTTGGCGTTGGAG<br>ACGCCTGTTAGGATCTTCAAGTCCCATCATAGAAAATTGAAACACAGAGTTGTTCTG<br>CTGATAGTTTTGGGGATACGTCTTCTTTTTAAGGGATTGCTTTCATCTAATTCTGG<br>CAGGACCTCACCAAAAGATCCAGCCTCATACCTACATCAGACAAAATATCGCCGTTG<br>TTCCTTCTGTACTAAAGTATTGTGTTTTGCTTTGGAAACACCCACTCACTTTGCAAT<br>AGCCGTGCAAGATGAATGCAGATTACACTGATCTTATGTGTTACAAAATTGGAGAAA<br>GTATTTAATAAAACCTGTTAATTTTTATACTGACAATAAAAATGTTTCTACAGATAT<br>TAATGTTAACAAGACAAAATAAATGTCACGCAACTTA |
| SEQ ID<br>NO: 22 | FGFR2<br>isoform 2<br>Amino acid<br>sequence | MVSWGRFICLVVVTMATLSLARPSFSLVEDTTLEPEEPPTKYQISQPEVYVAAPGES<br>LEVRCLLKDAAVISWTKDGVHLGPNNRTVLIGEYLQIKGATPRDSGLYACTASRTVD<br>SETWYFMVNVTDAISSGDDEDDTDGAEDFVSENSNNKRAPYWTNTEKMEKRLHAVPA<br>ANTVKFRCPAGGNPMPTMRWLKNGKEFKQEHRIGGYKVRNQHWSLIMESVVPSDKGN<br>YTCVVENEYGSINHTYHLDVVERSPHRPILQAGLPANASTVVGGDVEFVCKVYSDAQ<br>PHIQWIKHVEKNGSKYGPDGLPYLKVLKAAGVNTTDKEIEVLYIRNVTFEDAGEYTC<br>LAGNSIGISFHSAWLTVLPAPGREKEITASPDYLEIAIYCIGVFLIACMVVTVILCR<br>MKNTTKKPDFSSQPAVHKLTKRIPLRRQVTVSAESSSSMNSNTPLVRITTRLSSTAD<br>TPMLAGVSEYELPEDPKWEFPRDKLTLGKPLGEGCFGQVVMAEAVGIDKDKPKEAVT<br>VAVKMLKDDATEKDLSDLVSEMEMMKMIGKHKNIINLLGACTQDGPLYVIVEYASKG<br>NLREYLRARRPPGMEYSYDINRVPEEQMTFKDLVSCTYQLARGMEYLASQKCIHRDL<br>AARNVLVTENNVMKIADFGLARDINNIDYYKKTTNGRLPVKWMAPEALFDRVYTHQS<br>DVWSFGVLMWEIFTLGGSPYPGIPVEELFKLLKEGHRMDKPANCTNELYMMMRDCWH<br>AVPSQRPTFKQLVEDLDRILTLTTNEEYLDLSQPLEQYSPSYPDTRSSCSSGDDSVF<br>SPDPMPYEPCLPQYPHINGSVKT |
| SEQ ID<br>NO: 23 | FGFR2<br>isoform 3<br>Nucleic acid<br>sequence | ACAGACTCTCCCGCAGAACTGACCCCAGCAAGAAGCCTTTGGGAGCAGTAGAGATGG<br>AGTTTCACTATGTTGCCCAGGCTAGCCTTGAACTCCTGACCTCAGATGATCTGCCCG<br>CGCAGGCCTCCCGAAGTGCTGGGATTACAGGCATGAGCCACCGCACCTGGCCTGCCA<br>ACTCTTGTTAAGATCTCGAAGGAAACATTTTCTTCCCCTGAAGGAAACCCAGCTATG<br>CAGACACCAGCTGATAATCTTGCATTCCTGAAAGATGTTGCACCCCTATGGCAAGTG<br>GCGGCTGCTGAGGCTCTGACGTGACTCCCAGGCATGAACGCTCTCAGCTGTGTTTAC<br>CTCAGCTCCTCGGGAGGGAGCCTGGAGACTGACGCCTGAGTTTTACATCAGTGTCA<br>AAACCCAAGCACAACCTAGGGAGGGACCTCCTGCCTAGTGTGTGTGGGTCAGGAGAT<br>AGAAAAGCTCTCACTGAGTAAACTGGACAAGGTCAATATACCTCGCTGATTGAGAAG<br>ACTTCACTCTCTCTGCAAAGAGACGTGTGTGTTTAGAGGAAGTGGGAGCCCCAGCC<br>GATTCTGCAAGACTTCCGAGAGTCAGATATCCAGACAGAAGATGCGGACACCTGGGT<br>GACCAGACAGCGAAGAGGAAAGAACAAAACGAGCATGTGCCAAGCCTGTGAGGGAGA<br>AAGGGCAACAAACCAGTGACCTTCCACAGAAATGTGTTTAAACAAAACAAACAGCT<br>CTTTGGCGTTGCTAAGAGACTGCCATTTTGGAGGGAAAGAGCGATCGCCTCACCGGCC<br>CATCCTCCAAGCCGGACTGCCGGCAAATGCCTCCACAGTGGTCGGAGGAGACGTAGA<br>GTTTGTCTGCAAGGTTTACAGTGATGCCCAGCCCCACATCCAGTGGATCAAGCACGT<br>GGAAAAGAACGGCAGTAAATACGGGCCCGACGGGCTGCCCTACCTCAAGGTTCTCAA<br>GGCCGCCGGTGTTAACACCACGGACAAAGAGATTGAGGTTCTCTATATTCGGAATGT<br>AACTTTTGAGGACGCTGGGGAATATACGTGCTTGGCGGGTAATTCTATTGGGATATC<br>CTTTCACTCTGCATGGTTGACAGTTCTGCCAGCGCCTGGAAGAGAAAAGGAGATTAC<br>AGCTTCCCCAGACTACCTGGAGATAGCCATTTACTGCATAGGGGTCTTCTTAATCGC<br>CTGTATGGTGGTAACAGTCATCCTGTGCCGAATGAAGAACACGACCAAGAAGCCAGA<br>CTTCAGCAGCCAGCCGGCTGTGCACAAGCTGACCAAACGTATCCCCCTGCGGAGACA<br>GGTAACAGTTTCGGCTGAGTCCAGCTCCTCCATGAACTCCAACACCCCGCTGGTTCGA<br>GATAACAACACGCCTCTCTTCAACGGCAGACACCCCCATGCTGGCAGGGGTCTCCGA<br>GTATGAACTTCCAGAGGACCCAAATGGGAGTTTCAAGAGATAAGCTGACACTGGG<br>CAAGCCCCTGGGAGAAGGTTGCTTTGGGCAAGTGGTCATGGCGGAAGCAGTGGGAAT<br>TGACAAAGACAAGCCCAAGGAGGCGGTCACCGTGGCCGTGAAGATGTTGAAAGATGA<br>TGCCACAGAGAAAGACCTTTCTGATCTGGTGTCAGAGATGGAGATGATGAAGATGAT<br>TGGGAAACACAAGAATATCATAAATCTTCTTGGAGCCTGCACACAGGATGGGCCTCT<br>CTATGTCATAGTTGAGTATGCCTCTAAAGGCAACCTCCGAGAATACCTCCGAGCCCG<br>GAGGCCACCCGGGATGGAGTACTCCTATGACATTAACCGTGTTCCTGAGGAGCAGAT<br>GACCTTCAAGGACTTGGTGTCATGCACCTACCAGCTGGCCAGAGGCATGGAGTACTT<br>GGCTTCCCAAAAATGTATTCATCGAGATTTAGCAGCCAGAAATGTTTTGGTAACAGA<br>AAACAATGTGATGAAAATAGCAGACTTTGGACTCGCCAGAGATATCAACAATATAGA<br>CTATTACAAAAGACCACCAATGGGCGGCTTCCAGTCAAGTGGATGGCTCCAGAAGC<br>CCTGTTTGATAGAGTATACACTCATCAGAGTGATGTCTGGTCCTTCGGGGTGTTAAT<br>GTGGGAGATCTTCACTTTAGGGGGCTCGCCCTACCCAGGGATTCCCGTGGAGGAACT<br>TTTTAAGCTGCTGAAGGAAGGACACAGAATGGATAAGCCAGCCAACTGCACCAACGA<br>ACTGTACATGATGATGAGGGACTGTTGGCATGCAGTGCCCTCCAGAGACCAACGTT<br>CAAGCAGTTGGTAGAAGACTTGGATCGAATTCTCACTCTCACAACCAATGAGGAATA<br>CTTGGACCTCAGCCAACCTCTCGAACAGTATTCACCTAGTTACCCTGACACAAGAAG<br>TTCTTGTTCTTCAGGAGATGATTCTGTTTTTTCTCCAGACCCCATGCCTTACGAACC<br>ATGCCTTCCTCAGTATCCACACATAAACGGCAGTGTTAAAACATGAATGACTGTGTC<br>TGCCTGTCCCCAAACAGGACAGCACTGGGAACCTAGCTACACTGAGCAGGGAGACCA<br>TGCCTCCCAGAGCTTGTTGTCTCCACTTGTATATATGGATCAGAGGAGTAAATAATT<br>GGAAAAGTAATCAGCATATGTGTAAAGATTTATACAGTTGAAAACTTGTAATCTTCC<br>CCAGGAGGAGAAGAAGGTTTCTGGAGCAGTGGACTGCCACAAGCCACCATGTAACCC<br>CTCTCACCTGCCGTGCGTACTGGCTGTGGACCAGTAGGACTCAAGGTGGACGTGCGT<br>TCTGCCTTCCTTGTTAATTTTGTAATAATTGGAGAAGATTTATGTCAGCACACACTT |

TABLE 5-continued

FGFR sequences.

|  |  |  |
|---|---|---|
|  |  | ACAGAGCACAAATGCAGTATATAGGTGCTGGATGTATGTAAATATATTCAAATTATG<br>TATAAATATATATTATATATTTACAAGGAGTTATTTTTTGTATTGATTTTAAATGGA<br>TGTCCCAATGCACCTAGAAAATTGGTCTCTCTTTTTTTAATAGCTATTTGCTAAATG<br>CTGTTCTTACACATAATTTCTTAATTTTCACCGAGCAGAGGTGGAAAAATACTTTTG<br>CTTTCAGGGAAAATGGTATAACGTTAATTTATTAATAAATTGGTAATATACAAAACA<br>ATTAATCATTTATAGTTTTTTTTGTAATTTAAGTGGCATTTCTATGCAGGCAGCACA<br>GCAGACTAGTTAATCTATTGCTTGGACTTAACTAGTTATCAGATCCTTTGAAAAGAG<br>AATATTTACAATATATGACTAATTTGGGGAAAATGAAGTTTTGATTTATTTGTGTTT<br>AAATGCTGCTGTCAGACGATTGTTCTTAGACCTCCTAAATGCCCCATATTAAAAGAA<br>CTCATTCATAGGAAGGTGTTTCATTTTGGTGTGCAACCCTGTCATTACGTCAACGCA<br>ACGTCTAACTGGACTTCCCAAGATAAATGGTACCAGCGTCCTCTTAAAAGATGCCTT<br>AATCCATTCCTTGAGGACAGACCTTAGTTGAAATGATAGCAGAATGTGCTTCTCTCT<br>GGCAGCTGGCCTTCTGCTTCTGAGTTGCACATTAATCAGATTAGCCTGTATTCTCTT<br>CAGTGAATTTTGATAATGGCTTCCAGACTCTTTGGCGTTGGAGACGCCTGTTAGGAT<br>CTTCAAGTCCCATCATAGAAAATTGAAACACAGAGTTGTTCTGCTGATAGTTTTAGG<br>GATACGTCCATCTTTTTAAGGGATTGCTTTCATCTAATTCTGGCAGGACCTCACCAA<br>AAGATCCAGCCTCATACCTACATCAGACAAAATATCGCCGTTGTTCCTTCTGTACTA<br>AAGTATTGTGTTTTGCTTTGGAAACACCCACTCACTTTGCAATAGCCGTGCAAGATG<br>AATGCAGATTACACTGATCTTATGTGTTACAAAATTGGAGAAAGTATTTAATAAAAC<br>CTGTTAATTTTTATACTGACAATAAAAATGTTTCTACAGATATTAATGTTAACAAGA |
| SEQ ID<br>NO: 24 | FGFR2<br>isoform 3<br>Amino acid<br>sequence | MCLNKTKQLFGVAKRLPFWRKERSPHRPILQAGLPANASTVVGGDVEFVCKVYSDAQ<br>PHIQWIKHVEKNGSKYGPDGLPYLKVLKAAGVNTTDKEIEVLYIRNVTFEDAGEYTC<br>LAGNSIGISFHSAWLTVLPAPGREKEITASPDYLEIAIYCIGVFLIACMVVTVILCR<br>MKNTTKKPDFSSQPAVHKLTKRIPLRRQVTVSAESSSSMNSNTPLVRITTRLSSTAD<br>TPMLAGVSEYELPEDPKWEFPRDKLTLGKPLGEGCFGQVVMAEAVGIDKDKPKEAVT<br>VAVKMLKDDATEKDLSDLVSEMEMMKMIGKHKNIINLLGACTQDGPLYVIVEYASKG<br>NLREYLRARRPPGMEYSYDINRVPEEQMTFKDLVSCTYQLARGMEYLASQKCIHRDL<br>AARNVLVTENNVMKIADFGLARDINNIDYYKKTTNGRLPVKWMAPEALFDRVYTHQS<br>DVWSFGVLMWEIFTLGGSPYPGIPVEELFKLLKEGHRMDKPANCTNELYMMMRDCWH<br>AVPSQRPTFKQLVEDLDRILTLTTNEEYLDLSQPLEQYSPSYPDTRSSCSSGDDSVF<br>SPDPMPYEPCLPQYPHINGSVKT |
| SEQ ID<br>NO: 25 | FGFR2<br>isoform 4<br>Nucleic acid<br>sequence | TGACTGCAGCAGCAGCGGCAGCGCCTCGGTTCCTGAGCCCACCGCAGGCTGAAGGCA<br>TTGCGCGTAGTCCATGCCCGTAGAGGAAGTGTGCAGATGGGATTAACGTCCACATGG<br>AGATATGGAAGAGGACCGGGGATTGGTACCGTAACCATGGTCAGCTGGGGTCGTTTC<br>ATCTGCCTGGTCGTGGTCACCATGGCAACCTTGTCCCTGGCCCGGCCCTCCTTCAGT<br>TTAGTTGAGGATACCACATTAGAGCCAGAAGAGCCACCAACCAAATACCAAATCTCT<br>CAACCAGAAGTGTACGTGGCTGCGCAGGGGAGTCGCTAGAGGTCGCGTGCCTGTTG<br>AAAGATGCCGCCGTGATCAGTTGGACTAAGGATGGGGTGCACTTGGGGCCCAACAAT<br>AGGACAGTGCTTATTGGGGAGTACTTGCAGATAAAGGGCGCCACGCCTAGAGACTCC<br>GGCCTCTATGCTTGTACTGCCAGTAGGACTGTAGACAGTGAAACTTGGTACTTCATG<br>GTGAATGTCACAGATGCCATCTCATCCGGAGATGATGAGGATGACACCGATGGTGCG<br>GAAGATTTTGTCAGTGAGAACAGTAACAACAAGAGAGCACCATACTGGACCAACACA<br>GAAAAGATGCAAAAGCGGCTCCATGCTGTGCCTGCGGCCAACACTGTCAAGTTTCGC<br>TGCCCAGCCGGGGGGAACCCAATGCCAACCATGCGGTGGCTGAAAAACGGGAAGGAG<br>TTTAAGCAGGAGCATCGCATTGGAGGCTACAAGGTACGAAACCAGCACTGGAGCCTC<br>ATTATGGAAAGTGTGGTCCCATCTGACAAGGGAAATTATACCTGTGTAGTGGGAAT<br>GAATACGGGTCCATCAATCACACGTACCACCTGGATGTTGTGGCGCCTGGAAGAGAA<br>AAGGAGATTACAGCTTCCCAGACTACCTGGAGATAGCCATTTACTGCATAGGGGTC<br>TTCTTAATCGCCTGTATGGTGGTAACAGTCATCCTGTGCCGAATGAAGAACACGACC<br>AAGAAGCCAGACTTCAGCAGCCAGCCGGCTGTGCACAAGCTGACCAAACGTATCCCC<br>CTGCGGAGACAGGTAACAGTTTCGGCTGAGTCCAGCTCCTCCATGAACTCCAACACC<br>CCGCTGGTGAGGATAACAACACGCCTCTCTTCAACGGCAGACACCCCCATGCTGGCA<br>GGGGTCTCCGAGTATGAACTTCCAGAGGACCCAAAATGGGAGTTTCCAAGAGATAAG<br>CTGACACTGGGCAAGCCCCTGGGAGAAGGTTGCTTTGGGCAAGTGGTCATGGCGGAA<br>GCAGTGGGAATTGACAAAGACAAGCCCAAGGAGGCGGTCACCGTGGCCGTGAAGATG<br>TTGAAAGATGATGCCACAGAGAAGACCTTTCTGATCTGGTGTCAGAGATGGAGATG<br>ATGAAGATGATTGGGAAACAAGAATATCATAAATCTTCTTGGAGCCTGCACACAG<br>GATGGGCCTCTCTATGTCATAGTTGAGTATGCCTCTAAAGGCAACCTCCGAGAATAC<br>CTCCGAGCCCGGAGGCCACCCGGGATGGAGTACTCCTATGACATTAACCGTGTTCCT<br>GAGGAGCAGATGACCTTCAAGGACTTGGTGTCATGCACCTACCAGCTGGCCAGAGGC<br>ATGGAGTACTTGGCTTCCCAAAAATGTATTCATCGAGATTTAGCAGCCAGAAATGTT<br>TTGGTAACAGAAAACAATGTGATGAAATAGCAGATTTGGACTCGCCAGAGATATC<br>AACAATATAGACTATTACAAAAAGACCACCAATGGGCGGCTTCCAGTCAAGTGGATG<br>GCTCCAGAAGCCCTGTTTGATAGAGTATACACTCATCAGAGTGATGTCTGGTCCTTC<br>GGGGTGTTAATGTGGGAGATCTTCACTTTAGGGGGCTCGCCCTACCCAGGGATTCCC<br>GTGGAGGAACTTTTTAAGCTGCTGAAGGAAGGACACAGAATGGATAAGCCAGCCAAC<br>TGCACCAACGAACTGTACATGATGATGAGGGACTGTTGGCATGCAGTGCCCTCCCAG<br>AGACCAACGTTCAAGCAGTTGGTAGAAGACTTGGATCGAATTCTCACTCTCACAACC<br>AATGAGGAATACTTGGACCTCAGCCAACCTCTCGAACAGTATTCACCTAGTTACCCT<br>GACACAAGAAGTTCTTGTTCTTCAGGAGATGATTCTGTTTTTTCTCCAGACCCCATG<br>CCTTACGAACCGCCTTCCTCAGTATCCACAAATAAACGGCAGTGTTAAAACATGA<br>ATGACTGTGTCTGCCTGTCCCCAAACAGGACAGCACTGGGAACCTAGCTACACTGAG<br>CAGGGAGACCATGCCTCCCAGAGCTTGTTGTCTCCACTTGTATATATGGATCAGAGG<br>AGTAAATAATTGGAAAAGTAATCAGCATATGTGTAAAGATTTATACAGTTGAAAACT<br>TGTAATCTTCCCCAGGAGGAAGAAGGTTTCTGGAGCAGTGGACTGCCACAAGCCA<br>CCATGTAACCCCTCTCACCTGCCGTGCGTACTGGCTGTGGACCAGTAGGACTCAAGG |

TABLE 5-continued

FGFR sequences.

|  |  |  |
|---|---|---|
|  |  | TGGACGTGCGTTCTGCCTTCCTTGTTAATTTTGTAATAATTGGAGAAGATTTATGTC<br>AGCACACACTTACAGAGCACAAATGCAGTATATAGGTGCTGGATGTATGTAAATATA<br>TTCAAATTATGTATAAATATATATTATATATTTACAAGGAGTTATTTTTTGTATTGA<br>TTTTAAATGGATGTCCCAATGCACCTAGAAAATTGGTCTCTCTTTTTTTAATAGCTA<br>TTTGCTAAATGCTGTTCTTACACATAATTTCTTAATTTTCACCGAGCAGAGGTGGAA<br>AAATACTTTTGCTTTCAGGGAAAATGGTATAACGTTAATTTATTAATAAATTGGTAA<br>TATACAAAACAATTAATCATTTATAGTTTTTTTTGTAATTTAAGTGGCATTTCTATG<br>CAGGCAGCACAGCAGACTAGTTAATCTATTGCTTGGACTTAACTAGTTATCAGATCC<br>TTTGAAAAGAGAATATTTACAATATATGACTAATTTGGGGAAAATGAAGTTTTGATT<br>TATTTGTGTTTAAATGCTGCTGTCAGACGATTGTTCTTAGACCTCCTAAATGCCCCA<br>TATTAAAAGAACTCATTCATAGGAAGGTGTTTCATTTTGGTGTGCAACCCTGTCATT<br>ACGTCAACGCAACGTCTAACTGGACTTCCCAAGATAAATGGTACCAGCGTCCTCTTA<br>AAAGATGCCTTAATCCATTCCTTGAGGACAGACCTTAGTTGAAATGATAGCAGAATG<br>TGCTTCTCTCTGGCAGCTGGCCTTCTGCTTCTGAGTTGCACATTAATCAGATTAGCC<br>TGTATTCTCTTCAGTGAATTTTGATAATGGCTTCCAGACTCTTTGGCGTTGGAGACG<br>CCTGTTAGGATCTTCAAGTCCCATCATAGAAAATTGAAACACAGAGTTGTTCTGCTG<br>ATAGTTTTGGGGATACGTCCATCTTTTTAAGGGATTGCTTTCATCTAATTCTGGCAG<br>GACCTCACCAAAAGATCCAGCCTCATACCTACATCAGACAAAATATCGCCGTTGTTC<br>CTTCTGTACTAAAGTATTGTGTTTTGCTTTGGAAACACCCACTCACTTTGCAATAGC<br>CGTGCAAGATGAATGCAGATTACACTGATCTTATGTGTTACAAAATTGGAGAAAGTA<br>TTTAATAAAACCTGTTAATTTTTATACTGACAATAAAAATGTTTCTACAGATATTAA<br>TGTTAACAAGACAAATAAATGTCACGCAACTTATTTTTTT |
| SEQ ID<br>NO: 26 | FGFR2<br>isoform 4<br>Amino acid<br>sequence | MVSWGRFICLVVVTMATLSLARPSFSLVEDTTLEPEEPPTKYQISQPEVYVAAPGES<br>LEVRCLLKDAAVISWTKDGVHLGPNNRTVLIGEYLQIKGATPRDSGLYACTASRTVD<br>SETWYFMVNVTDAISSGDDEDDTDGAEDFVSENSNNKRAPYWTNTEKMEKRLHAVPA<br>ANTVKFRCPAGGNPMPTMRWLKNGKEFKQEHRIGGYKVRNQHWSLIMESVVPSDKGN<br>YTCVVENEYGSINHTYHLDVVAPGREKEITASPDYLEIAIYCIGVFLIACMVVTVIL<br>CRMKNTTKKPDFSSQPAVHKLTKRIPLRRQVTVSAESSSSMNSNTPLVRITTRLSST<br>ADTPMLAGVSEYELPEDPKWEFPRDKLTLGKPLGEGCFGQVVMAEAVGIDKDKPKEA<br>VTVAVKMLKDDATEKDLSDLVSEMEMMKMIGKHKNIINLLGACTQDGPLYVIVEYAS<br>KGNLREYLRARRPPGMEYSYDINRVPEEQMTFKDLVSCTYQLARGMEYLASQKCIHR<br>DLAARNVLVTENNVMKIADFGLARDINNIDYYKKTTNGRLPVKWMAPEALFDRVYTH<br>QSDVWSFGVLMWEIFTLGGSPYPGIPVEELFKLLKEGHRMDKPANCTNELYMMMRDC<br>WHAVPSQRPTFKQLVEDLDRILTLTTNEEYLDLSQPLEQYSPSYPDTRSSCSSGDDS<br>VFSPDPMPYEPCLPQYPHINGSVKT |
| SEQ ID<br>NO: 27 | FGFR2<br>isoform 5<br>Nucleic acid<br>sequence | AATTTGTTGAGGAATTTCCCCCTAGCCTTGACCCCTTGACAGCTCCCGCTCCTACTC<br>AGTGCTGGGGAGAAGTAGGGAGGCCTTAAGCGAAGAGATGGGTCTGCACTTTGGAGG<br>AGCCGGACACTGTTGACTTTCCTGATGTGAAATCTACCCAGGAACAAAACACCAGTG<br>ACTGCAGCAGCAGCGGCAGCGCCTCGGTTCCTGAGCCCACCGCAGGCTGAAGGCATT<br>GCGCGTAGTCCATGCCCGTAGAGGAAGTGTGCAGATGGGATTAACGTCCACATGGAG<br>ATATGGAAGAGGACCGGGGATTGGTACCGTAACCATGGTCAGCTGGGGTCGTTTCAT<br>CTGCCTGGTCGTGGTCACCATGGCAACCTTGTCCCTGGCCCGGCCCTCCTTCAGTTT<br>AGTTGAGGATACCACATTAGAGCCAGAAGATGCCATCTCATCCGGAGATGATGAGGA<br>TGACACCGATGGTGCGGAAGATTTTGTCAGTGAGAACAGTAACAACAAGAGAGCACC<br>ATACTGGACCAACACAGAAAAGATGGAAAAGCGGCTCCATGCTGTGCCTGCGGCCAA<br>CACTGTCAAGTTTCGCTGCCCAGCCGGGGGGAACCCAATGCCAACCATGCGGTGGCT<br>GAAAAACGGGAAGGAGTTTAAGCAGGAGCATCGCATTGGAGGCTACAAGGTACGAAA<br>CCAGCACTGGAGCCTCATTATGGAAAGTGTGGTCCCATCTGACAAGGGAAATTATAC<br>CTGTGTAGTGGAGAATGAATACGGGTCCATCAATCACACGTACCACCTGGATGTTGT<br>GGAGCGATCGCCTCACCGGCCCATCCTCCAAGCCGGACTGCCGGCAAATGCCTCCAC<br>AGTGGTCGGAGGAGACGTAGAGTTTGTCTGCAAGGTTTACAGTGATGCCCAGCCCCA<br>CATCCAGTGGATCAAGCACGTGGAAAAGAACGGCAGTAAATACGGGCCCGACGGGCT<br>GCCCTACCTCAAGGTTCTCAAGGCCGCCGGTGTTAACACCACGGACAAAGAGATTGA<br>GGTTCTCTATATTCGGAATGTAACTTTTGAGGACGCTGGGGAATATACGTGCTTGGC<br>GGGTAATTCTATTGGGATATCCTTTCACTCTGCATGGTTGACAGTTCTGCCAGCGCC<br>TGGAAGAGAAAAGGAGATTACAGCTTCCCCAGACTACCTGGAGATAGCCATTTACTG<br>CATAGGGGTCTTCTTAATCGCCTGTATGGTGGTAACAGTCATCCTGTGCCGAATGAA<br>GAACACGACCAAGAAGCCAGACTTCAGCAGCCAGCCGGCTGTGCACAAGCTGACCAA<br>ACGTATCCCCCTGCGGAGACAGGTAACAGTTTCGGCTGAGTCCAGCTCCTCCATGAA<br>CTCCAACACCCCGCTGGTGAGGATAACAACACGCCTCTCTTCAACGGCAGACACCCC<br>CATGCTGGCAGGGGTCTCCGAGTATGAACTTCCAGAGGACCCAAAATGGGAGTTTCC<br>AAGAGATAAGCTGACACTGGGCAAGCCCCTGGGAGAAGGTTGCTTTGGGCAAGTGGT<br>CATGGCGGAAGCAGTGGGAATTGACAAAGACAAGCCCAAGGAGGCGGTCACCGTGGC<br>CGTGAAGATGTTGAAAGATGATGCCACAGAGAAAGACCTTTCTGATCTGGTGTCAGA<br>GATGGAGATGATGAAGATGATTGGGAAACACAAGAATATCATAAATCTTCTTGGAGC<br>CTGCACACAGGATGGGCCTCTCTATGTCATAGTTGAGTATGCCTCTAAAGGCAACCT<br>CCGAGAATACCTCCGAGCCCGGAGGCCACCCGGGATGGAGTACTCCTATGACATTAA<br>CCGTGTTCCTGAGGAGCAGATGACCTTCAAGGACTTGGTGTCATGCACCTACCAGCT<br>GGCCAGAGGCATGGAGTACTTGGCTTCCCAAAAATGTATTCATCGAGATTTAGCAGC<br>CAGAAATGTTTTGGTAACAGAAAACAATGTGATGAAAATAGCAGACTTTGGACTCGC<br>CAGAGATATCAACAATATAGACTATTACAAAAAGACCACCAATGGGCGGCTTCCAGT<br>CAAGTGGATGGCTCCAGAAGCCCTGTTTGATAGAGTATACACTCATCAGAGTGATGT<br>CTGGTCCTTCGGGGTGTTAATGTGGGAGATCTTCACTTTAGGGGGCTCGCCCTACCC<br>AGGGATTCCCGTGGAGGAACTTTTTAAGCTGCTGAAGGAAGGACACAGAATGGATAA<br>GCCAGCCAACTGCACCAACGAACTGTACATGATGATGAGGGACTGTTGGCATGCAGT<br>GCCCTCCCAGAGACCAACGTTCAAGCAGTTGGTAGAAGACTTGGATCGAATTCTCAC |

TABLE 5-continued

FGFR sequences.

|  |  |  |
|---|---|---|
|  |  | TCTCACAACCAATGAGGAGGAGAAGAAGGTTTCTGGAGCAGTGGACTGCCACAAGCC<br>ACCATGTAACCCCTCTCACCTGCCGTGCGTACTGGCTGTGGACCAGTAGGACTCAAG<br>GTGGACGTGCGTTCTGCCTTCCTTGTTAATTTTGTAATAATTGGAGAAGATTTATGT<br>CAGCACACACTTACAGAGCACAAATGCAGTATATAGGTGCTGGATGTATGTAAATAT<br>ATTCAAATTATGTATAAATATATATTATATATTTACAAGGAGTTATTTTTTGTATTG<br>ATTTTAAATGGATGTCCCAATGCACCTAGAAAATTGGTCTCTCTTTTTTTAATAGCT<br>ATTTGCTAAATGCTGTTCTTACACATAATTTCTTAATTTTCACCGAGCAGAGGTGGA<br>AAAATACTTTTGCTTTCAGGGAAAATGGTATAACGTTAATTTATTAATAAATTGGTA<br>ATATACAAAACAATTAATCATTTATAGTTTTTTTTGTAATTTAAGTGGCATTTCTAT<br>GCAGGCAGCACAGCAGACTAGTTAATCTATTGCTTGGACTTAACTAGTTATCAGATC<br>CTTTGAAAAGAGAATATTTACAATATATGACTAATTTGGGGAAAATGAAGTTTTGAT<br>TTATTTGTGTTTAAATGCTGCTGTCAGACGATTGTTCTTAGACCTCCTAAATGCCCC<br>ATATTAAAAGAACTCATTCATAGGAAGGTGTTTCATTTTGGTGTGCAACCCTGTCAT<br>TACGTCAACGCAACGTCTAACTGGACTTCCCAAGATAAATGGTACCAGCGTCCTCTT<br>AAAAGATGCCTTAATCCATTCCTTGAGGACAGACCCTTAGTTGAAATGATAGCAGAAT<br>GTGCTTCTCTCTGGCAGCTGGCCTTCTGCTTCTGAGTTGCACATTAATCAGATTAGC<br>CTGTATTCTCTTCAGTGAATTTTGATAATGGCTTCCAGACTCTTTGGCGTTGGAGAC<br>GCCTGTTAGGATCTTCAAGTCCCATCATAGAAAATTGAAACACAGAGTTGTTCTGCT<br>GATAGTTTTGGGGATACGTCCATCTTTTTAAGGGATTGCTTTCATCTAATTCTGGCA<br>GGACCTCACCAAAAGATCCAGCCTCATACCTACATCAGACAAAATATCGCCGTTGTT<br>CCTTCTGTACTAAAGTATTGTGTTTTGCTTGGAAACACCCACTCACTTTGCAATAG<br>CCGTGCAAGATGAATGCAGATTACACTGATCTTATGTGTTACAAAATTGGAGAAAGT<br>ATTTAATAAAACCTGTTAATTTTTATACTGACAATAAAAATGTTTCTACAGATATTA<br>ATGTTAACAAGACAAAATAAATGTCACGCAACTTATTTTTTT |
| SEQ ID<br>NO. 28 | FGFR2<br>isoform 5<br>Amino acid<br>sequence | MVSWGRFICLVVVTMATLSLARPSFSLVEDTTLEPEDAISSGDDEDDTDGAEDFVSE<br>NSNNKRAPYWTNTEKMEKRLHAVPAANTVKFRCPAGGNPMPTMRWLKNGKEFKQEHR<br>IGGYKVRNQHWSLIMESVVPSDKGNYTCVVENEYGSINHTYHLDVVERSPHRPILQA<br>GLPANASTVVGGDVEFVCKVYSDAQPHIQWIKHVEKNGSKYGPDGLPYLKVLKAAGV<br>NTTDKEIEVLYIRNVTFEDAGEYTCLAGNSIGISFHSAWLTVLPAPGREKEITASPD<br>YLEIAIYCIGVFLIACMVVTVILCRMKNTTKKPDFSSQPAVHKLTKRIPLRRQVTVS<br>AESSSSMNSNTPLVRITTRLSSTADTPMLAGVSEYELPEDPKWEFPRDKLTLGKPLG<br>EGCFGQVVMAEAVGIDKDKPKEAVTVAVKMLKDDATEKDLSDLVSEMEMMKMIGKHK<br>NIINLLGACTQDGPLYVIVEYASKGNLREYLRARRPPGMEYSYDINRVPEEQMTFKD<br>LVSCTYQLARGMEYLASQKCIHRDLAARNVLVTENNVMKIADFGLARDINNIDYYKK<br>TTNGRLPVKWMAPEALFDRVYTHQSDVWSFGVLMWEIFTLGGSPYPGIPVEELFKLL<br>KEGHRMDKPANCTNELYMMMRDCWHAVPSQRPTFKQLVEDLDRILTLTTNEEEKKVS<br>GAVDCHKPPCNPSHLPCVLAVDQ |
| SEQ ID<br>NO. 29 | FGFR2<br>isoform 6<br>Nucleic acid<br>sequence | GGCGGCGGCTGGAGGAGAGCGCGGTGGAGAGCCGAGCGGGCGGGCGGCGGGTGCGGA<br>GCGGGCGAGGGAGCGCGCGCGGCCGCCACAAAGCTCGGGCGCCGCGGGGCTGCATGC<br>GGCGTACCTGGCCCGGCGCGGCGACTGCTCTCGGGCTGGCGGGGGCCGGCCGCGAG<br>CCCCGGGGGCCCCGAGGCCGCAGCTTGCCTGCGCGCTCTGAGCCTTCGCAACTCGCG<br>AGCAAAGTTTGGTGGAGGCAACGCCAAGCCTGAGTCCTTTCTTCCTCTCGTTCCCCA<br>AATCCGAGGGCAGCCCGCGGGCGTCATGCCCGCGCTCCTCCGCAGCCTGGGGTACGC<br>GTGAAGCCCGGGAGGCTTGGCGCCGGCGAAGACCCAAGGACCACTCTTCTGCGTTTG<br>GAGTTGCTCCCCGCAACCCCGGGCTCGTCGCTTTCTCCATCCCGACCCACGCGGGGC<br>GCGGGGACAACACAGGTCGCGGAGGAGCGTTGCCATTCAAGTGACTGCAGCAGCAGC<br>GGCAGCGCCTCGGTTCCTGAGCCCACCGCAGGCTGAAGGCATTGCGCGTAGTCCATG<br>CCCGTAGAGGAAGTGTGCAGATGGGATTAACGTCCACATGGAGATATGGAAGAGGAC<br>CGGGGATTGGTACCGTAACCATGGTCAGCTGGGGTCGTTTCATCTGCCTGGTCGTGG<br>TCACCATGGCAACCTTGTCCCTGGCCCGGCCCTCCTTCAGTTTAGTTGAGGATACCA<br>CATTAGAGCCAGAAGGAGCACCATACTGGACCAACACAGAAAAGATGGAAAAGCGGC<br>TCCATGCTGTGCCTGCGGCCAACACTGTCAAGTTTCGCTGCCCAGCCGGGGGGAACC<br>CAATGCCAACCATGCGGTGGCTGAAAAACGGGAAGGAGTTTAAGCAGGAGCATCGCA<br>TTGGAGGCTACAAGGTACGAAACCAGCACTGGAGCCTCATTATGGAAAGTGTGGTCC<br>CATCTGACAAGGGAAATTATACCTGTGTAGTGGAGAATGAATACGGGTCCATCAATC<br>ACACGTACCACCTGGATGTTGTGGAGCGATCGCCTCACCGGCCCATCCTCCAAGCCG<br>GACTGCCGGCAAATGCCTCCACAGTGGTCGGAGGAGACGTAGAGTTTGTCTGCAAGG<br>TTTACAGTGATGCCCAGCCCCACATCCAGTGGATCAAGCACGTGGAAAAGAACGGCA<br>GTAAATACGGGCCCGACGGGCTGCCCTACCTCAAGGTTCTCAAGGCCGCCGGTGTTA<br>ACACCACGGACAAAGAGATTGAGGTTCTCTATATTCGGAATGTAACTTTTGAGGACG<br>CTGGGGAATATACGTGCTTGGCGGGTAATTCTATTGGGATATCCTTTCACTCTGCAT<br>GGTTGACAGTTCTGCCAGCGCCTGGAAGAGAAAAGGAGATTACAGCTTCCCCAGACT<br>ACCTGGAGATAGCCATTTACTGCATAGGGGTCTTCTTAATCGCCTGTATGGTGGTAA<br>CAGTCATCCTGTGCCGAATGAAGAACACGACCAAGAAGCCAGACTTCAGCAGCCAGC<br>CGGCTGTGCACAAGCTGACCAAACGTATCCCCCTGCGGAGACAGGTTTCGGCTGAGT<br>CCAGCTCCTCCATGAACTCCAACACCCCGCTGGTGAGGATAACAACACGCCTCTCTT<br>CAACGGCAGACACCCCCATGCTGGCAGGGGTCTCCGAGTATGAACTTCCAGAGGACC<br>CAAAATGGGAGTTTCCAAGAGATAAGCTTGACACTGGGCAAGCCCCTGGGAGAAGGTT<br>GCTTTGGGCAAGTGGTCATGGCGGAAGCAGTGGGAATTGACAAAGACAAGCCCAAGG<br>AGGCGGTCACCGTGGCCGTGAAGATGTTGAAAGATGATGCCACAGAGAAAGACCTTT<br>CTGATCTGGTGTCAGAGATGGAGATGATGAAGATGATTGGGAAGCACAAGAATATCA<br>TAAATCTTCTTGGAGCCTGCACACAGGATGGGCCTCTCTATGTCATAGTTGAGTATG<br>CCTCTAAAGGCAACCTCCGAGAATACCTCCGAGCCCGGAGGCCACCCGGGATGGAGT<br>ACTCCTATGACATTAACCGTGTTCCTGAGGAGCAGATGACCTTCAAGGACTTGGTGT<br>CATGCACCTACCAGCTGGCCAGAGGCATGGAGTACTTGGCTTCCCAAAAATGTATTC<br>ATCGAGATTTAGCAGCCAGAAATGTTTTGGTAACAGAAAACAATGTGATGAAAATAG |

TABLE 5-continued

FGFR sequences.

|  |  |  |
|---|---|---|
|  |  | CAGACTTTGGACTCGCCAGAGATATCAACAATATAGACTATTACAAAAAGACCACCA<br>ATGGGCGGCTTCCAGTCAAGTGGATGGCTCCAGAAGCCCTGTTTGATAGAGTATACA<br>CTCATCAGAGTGATGTCTGGTCCTTCGGGGTGTTAATGTGGGAGATCTTCACTTTAG<br>GGGGCTCGCCCTACCCAGGGATTCCCGTGGAGGAACTTTTTAAGCTGCTGAAGGAAG<br>GACACAGAATGGATAAGCCAGCCAACTGCACCAACGAACTGTACATGATGATGAGGG<br>ACTGTTGGCATGCAGTGCCCTCCCAGAGACCAACGTTCAAGCAGTTGGTAGAAGACT<br>TGGATCGAATTCTCACTCTCACAACCAATGAGGAATACTTGGACCTCAGCCAACCTC<br>TCGAACAGTATTCACCTAGTTACCCTGACACAAGAAGTTCTTGTTCTTCAGGAGATG<br>ATTCTGTTTTTTCTCCAGACCCCATGCCTTACGAACCATGCCTTCCTCAGTATCCAC<br>ACATAAACGGCAGTGTTAAAACATGAATGACTGTGTCTGCCTGTCCCCAAACAGGAC<br>AGCACTGGGAACCTAGCTACACTGAGCAGGGAGACCATGCCTCCCAGAGCTTGTTGT<br>CTCCACTTGTATATATGGATCAGAGGAGTAAATAATTGGAAAAGTAATCAGCATATG<br>TGTAAAGATTTATACAGTTGAAAACTTGTAATCTTCCCCAGGAGGAGAAGAAGGTTT<br>CTGGAGCAGTGGACTGCCACAAGCCACCATGTAACCCCTCTCACCTGCCGTGCGTAC<br>TGGCTGTGGACCAGTAGGACTCAAGGTGGACGTGCGTTCTGCCTTCCTTGTTAATTT<br>TGTAATAATTGGAGAAGATTTATGTCAGCACACACTTACAGAGCACAAATGCAGTAT<br>ATAGGTGCTGGATGTATGTAAATATATTCAATTATGTATAAATATATATTATATAT<br>TTACAAGGAGTTATTTTTGTATTGATTTTAAATGGATGTCCCAATGCACCTAGAAA<br>ATTGGTCTCTCTTTTTTTAATAGCTATTTGCTAAATGCTGTTCTTACACATAATTTC<br>TTAATTTTCACCGAGCAGAGGTGGAAAAATACTTTTGCTTTCAGGGAAAATGGTATA<br>ACGTTAATTTATTAATAAATTGGTAATATACAAAACAATTAATCATTTATAGTTTTT<br>TTTGTAATTTAAGTGGCATTTCTATGCAGGCAGCACAGCAGACTAGTTAATCTATTG<br>CTTGGACTTAACTAGTTATCAGATCCTTTGAAAAGAGAATATTTACAATATATGACT<br>AATTTGGGGAAAA |
| SEQ ID<br>NO: 30 | FGFR2<br>isoform 6<br>Amino acid<br>sequence | MVSWGRFICLVVVTMATLSLARPSFSLVEDTTLEPEGAPYWTNTEKMEKRLHAVPAA<br>NTVKFRCPAGGNPMPTMRWLKNGKEFKQEHRIGGYKVRNQHWSLIMESVVPSDKGNY<br>TCVVENEYGSINHTYHLDVVERSPHRPILQAGLPANASTVVGGDVEFVCKVYSDAQP<br>HIQWIKHVEKNGSKYGPDGLPYLKVLKAAGVNTTDKEIEVLYIRNVTFEDAGEYTCL<br>AGNSIGISFHSAWLTVLPAPGREKEITASPDYLEIAIYCIGVFLIACMVVTVILCRM<br>KNTTKKPDFSSQPAVHKLTKRIPLRRQVSAESSSSMNSNTPLVRITTRLSSTADTPM<br>LAGVSEYELPEDPKWEFPRDKLTLGKPLGEGCFGQVVMAEAVGIDKDKPKEAVTVAV<br>KMLKDDATEKDLSDLVSEMEMMKMIGKHKNIINLLGACTQDGPLYVIVEYASKGNLR<br>EYLRARRPPGMEYSYDINRVPEEQMTFKDLVSCTYQLARGMEYLASQKCIHRDLAAR<br>NVLVTENNVMKIADFGLARDINNIDYYKKTTNGRLPVKWMAPEALFDRVYTHQSDVW<br>SFGVLMWEIFTLGGSPYPGIPVEELFKLLKEGHRMDKPANCTNELYMMMRDCWHAVP<br>SQRPTFKQLVEDLDRILTLTTNEEYLDLSQPLEQYSPSYPDTRSSCSSGDDSVFSPD<br>PMPYEPCLPQYPHINGSVKT |
| SEQ ID<br>NO: 31 | FGFR2<br>isoform 7<br>Nucleic acid<br>sequence | CCGGCCGCGAGCCCCGGGGCCCCGAGGCCGCAGCTTGCCTGCGCGCTCTGAGCCTT<br>CGCAACTCGCGAGCAAAGTTTGGTGGAGGCAACGCCAAGCCTGAGTCCTTTCTTCCT<br>CTCGTTCCCCAAATCCGAGGGCAGCCCGCGGGCGTCATGCCCGCGCTCCTCCGCAGC<br>CTGGGGTACGCGTGAAGCCCGGGAGGCTTGGCGCCGGCGAAGACCCAAGGACCACTC<br>TTCTGCGTTTGGAGTTGCTCCCCGCCATCCCGGGCTCGTCGCTTTCTCCATCCCGAC<br>CCACGCGGGGCGCGGGGACAACACAGGTCGCGGAGGAGCGTTGCCATTCAAGTGACT<br>GCAGCAGCAGCGGCAGCGCCTCGGTTCCTGAGCCCACCGCAGGCTGAAGGCATTGCG<br>CGTAGTCCATGCCCGTAGAGGAAGTGTGCAGATGGGATTAACGTCCACATGGAGATA<br>TGGAAGAGGACCGGGGATTGGTACCGTAACCATGGTCAGCTGGGGTCGTTTCATCTG<br>CCTGGTCGTGGTCACCATGGCAACCTTGTCCCTGGCCCGGCCCTCCTTCAGTTTAGT<br>TGAGGATACCACATTAGAGCCAGAAGAGCCACCAACCAAATACCAAATCTCTCAACC<br>AGAAGTGTACGTGGCTGCGCCAGGGGAGTCGCTAGAGGTGCGCTGCCTGTTGAAAGA<br>TGCCGCCGTGATCAGTTGGACTAAGGATGGGGTGCACTTGGGGCCCAACAATAGGAC<br>AGTGCTTATTGGGGAGTACTTGCAGATAAAGGGCGCCACGCCTAGAGACTCCGGCCT<br>CTATGCTTGTACTGCCAGTAGGACTGTAGACAGTGAAACTTGGTACTTCATGGTGAA<br>TGTCACAGATGCCATCTCATCCGGAGATGATGAGGATGACACCGATGGTGCGGAAGA<br>TTTTGTCAGTGAGAACAGTAACAACAAGAGAGCCATACTGGACAACACAGAAAA<br>GATGGAAAAGCGGCTCCATGCTGTGCCTGCGGCCAACACTGTCAAGTTTCGCTGCCC<br>AGCCGGGGGGAACCCAATGCCAACCATGCGGTGGCTGAAAAACGGGAAGGAGTTTAA<br>GCAGGAGCATCGCATTGGAGGCTACAAGGTACGAAACCAGCACTGGAGCCTCATTAT<br>GGAAAGTGTGGTCCCATCTGACAAGGGGAAATTATACCTGTGTAGTGGAGAATGAATA<br>CGGGTCCATCAATCACACGTACCACCTGGATGTTGTGGAGCGATCGCCTCACCGGCC<br>CATCCTCCAAGCCGGACTGCCGGCAAATGCCTCCACAGTGGTCGGAGGAGACGTAGA<br>GTTTGTCTGCAAGGTTTACAGTGATGCCCAGCCCCACATCCAGTGGATCAAGCACGT<br>GGAAAAGAACGGCAGTAAATACGGGCCCGACGGGCTGCCCTACCTCAAGGTTCTCAA<br>GGTTTCGCTGAGTCCAGCTCCTCCATGAACTCCAACACCCCGCTGGTGAGGATAAC<br>AACACGCCTCTCTTCAACGGCAGACACCCCCATGCTGGCAGGGGTCTCCGAGTATGA<br>ACTTCCAGAGGACCCAAAATGGGAGTTTCCAAGAGATAAGCTGACACTGGGCAAGCC<br>CCTGGGAGAAGGTTGCTTTGGGCAAGTGGTCATGGCGGAAGCAGTGGGAATTGACAA<br>AGACAAGCCCAAGGAGGCGGTCACCGTGGCCGTGAAGATGTTGAAAGATGATGCCAC<br>AGAGAAAGACCTTTCTGATCTGGTGTCAGAGATGGAGATGATGAAGATGATTGGGAA<br>ACACAAGAATATCATAAATCTTCTTGGAGCCTGCACACAGGATGGGCCCTCTCTATGT<br>CATAGTTGAGTATGCCTCTAAAGGCAACCTCCGAGAATACCTCCGAGCCCGGAGGCC<br>ACCCGGGATGGAGTACTCCTATGACATTAACCGTGTTCCTGAGGAGCAGATGACCTT<br>CAAGGACTTGGTGTCATGCACCTACCAGCTGGCCAGAGGCATGGAGTACTTGGCTTC<br>CCAAAAATGTATTCATCGAGATTTAGCAGCCAGAAATGTTTTGGTAACAGAAAACAA<br>TGTGATGAAAATAGCAGACTTTGGACTCGCCAGAGATATCAACAATATAGACTATTA<br>CAAAAAGACCACCAATGGGCGGCTTCCAGTCAAGTGGATGGCTCCAGAAGCCCTGTT<br>TGATAGAGTATACACTCATCAGAGTGATGTCTGGTCCTTCGGGGTGTTAATGTGGGA |

TABLE 5-continued

FGFR sequences.

|  |  |  |
|---|---|---|
|  |  | GATCTTCACTTTAGGGGGCTCGCCCTACCCAGGGATTCCCGTGGAGGAACTTTTTAA<br>GCTGCTGAAGGAAGGACACAGAATGGATAAGCCAGCCAACTGCACCAACGAACTGTA<br>CATGATGATGAGGGACTGTTGGCATGCAGTGCCCTCCCAGAGACCAACGTTCAAGCA<br>GTTGGTAGAAGACTTGGATCGAATTCTCACTCTCACAACCAATGAGGAATACTTGGA<br>CCTCAGCCAACCTCTCGAACAGTATTCACCTAGTTACCCTGACACAAGAAGTTCTTG<br>TTCTTCAGGAGATGATTCTGTTTTTTCTCCAGACCCCATGCCTTACGAACCATGCCT<br>TCCTCAGTATCCACACATAAACGGCAGTGTTAAAACATGAATGACTGTGTCTGCCTG<br>TCCCCAAACAGGACAGCACTGGGAACCTAGCTACACTGAGCAGGGAGACCATGCCTC<br>CCAGAGCTTGTTGTCTCCACTTGTATATATGGATCAGAGGAGTAAATAATTGGAAAA<br>GTAATCAGCATATGTGTAAAGATTTATACAGTTGAAAACTTGTAATCTTCCCCAGGA<br>GGGAGAAGAAGGTTTCTGGAGCAGTGGACTGCCACAAGCCACCATGTAACCCCTCTCA<br>CCTGCCGTGCGTACTGGCTGTGACCAGTAGGACTCAAGGTGGACGTGCGTTCTGCC<br>TTCCTTGTTAATTTTGTAATAATTGGAGAAGATTTATGTCAGCACACACTTACAGAG<br>CACAAATGCAGTATATAGGTGCTGGATGTATGTAAATATATTCAAATTATGTATAAA<br>TATATATTTATATATTTACAAGGAGTTATTTTTTGTATTGATTTTAAATGGATGTCCC<br>AATGCACCTAGAAAATTGGTCTCTCTTTTTTTAATAGCTATTTGCTAAATGCTGTTC<br>TTACACATAATTTCTTAATTTTCACCGAGCAGAGGTGGAAAAATACTTTTGCTTTCA<br>GGGAAAATGGTATAACGTTAATTTATTAATAAATTGGTAATATACAAAACAA |
| SEQ ID<br>NO: 32 | FGFR2<br>isoform 7<br>Amino acid<br>sequence | MVSWGRFICLVVVTMATLSLARPSFSLVEDTTLEPEEPPTKYQISQPEVYVAAPGES<br>LEVRCLLKDAAVISWTKDGVHLGPNNRTVLIGEYLQIKGATPRDSGLYACTASRTVD<br>SETWYFMVNVTDAISSGDDEDDTDGAEDFVSENSNNKRAPYWTNTEKMEKRLHAVPA<br>ANTVKFRCPAGGNPMPTMRWLKNGKEFKQEHRIGGYKVRNQHWSLIMESVVPSDKGN<br>YTCVVENEYGSINHTYHLDVVERSPHRPILQAGLPANASTVVGGDVEFVCKVYSDAQ<br>PHIQWIKHVEKNGSKYGPDGLPYLKVLKVSAESSSSMNSNTPLVRITTRLSSTADTP<br>MLAGVSEYELPEDPKWEFPRDKLTLGKPLGEGCFGQVVMAEAVGIDKDKPKEAVTVA<br>VKMLKDDATEKDLSDLVSEMEMMKMIGKHKNIINLLGACTQDGPLYVIVEYASKGNL<br>REYLRARRPPGMEYSYDINRVPEEQMTFKDLVSCTYQLARGMEYLASQKCIHRDLAA<br>RNVLVTENNVMKIADFGLARDINNIDYYKKTTNGRLPVKWMAPEALFDRVYTHQSDV<br>WSFGVLMWEIFTLGGSPYPGIPVEELFKLLKEGHRMDKPANCTNELYMMMRDCWHAV<br>PSQRPTFKQLVEDLDRILTLTTNEEYLDLSQPLEQYSPSYPDTRSSCSSGDDSVFSP<br>DPMPYEPCLPQYPHINGSVKT |
| SEQ ID<br>NO: 33 | FGFR2<br>isoform 8<br>Nucleic acid<br>sequence | GAGCGGGCGAGGGAGCGCGCGCGGCCGCCACAAAGCTCGGGCGCCGCGGGGCTGCAT<br>GCGGCGTACCTGGCCCGGCGCGCGGACTGCTCTCCGGGCTGGCGGGGGCCGGCCGCG<br>AGCCCCGGGGGCCCCGAGGCCGCAGCTTGCCTGCGCGCTCTGAGCCTTCGCAACTCG<br>CGAGCAAAGTTTGGTGGAGGCAACGCCAAGCCTGAGTCCTTTCTTCCTCTCGTTCCC<br>CAAATCCGAGGGCAGCCCGCGGGCGTCATGCCCGCGCTCCTCCGCAGCCTGGGGTAC<br>GCGTGAAGCCCGGGAGGCTTGGCGCCGGCGAAGACCCAAGGACCACTCTTCTGCGTT<br>TGGAGTTGCTCCCCGCAACCCCGGGCTCGTCGCTTTCTCCATCCCGACCCACGCGG<br>GCGCGGGGACAACACAGGTCGCGGAGGAGCGTTGCCATTCAAGTGACTGCAGCAGCA<br>GCGGCAGCGCCTCGGTTCCTGAGCCCACCGCAGGCTGAAGGCATTGCGCGTAGTCCA<br>TGCCCGTAGAGGAAGTGTGCAGATGGGATTAACGTCCACATGGAGATATGGAAGAGG<br>ACCGGGGATTGGTACCGTAACCATGGTCAGCTGGGGTCGTTTCATCGTGCCTGGTCGT<br>GGTCACCATGGCAACCTTGTCCCTGGCCCGGCCCTCCTTCAGTTTAGTTGAGGATAC<br>CACATTAGAGCCAGAAGAGCCACCAACCAAATACCAAATCTCTCAACCAGAAGTGTA<br>CGTGGCTGCGCCAGGGGAGTCGCTAGAGGTGCGCTGCCTGTTAAAGATGCCGCCGT<br>GATCAGTTGGACTAAGGATGGGGTGCACTTGGGGCCCAACAATAGGACAGTGCTTAT<br>TGGGGAGTACTTGCAGATAAAGGGCGCCACGCCTAGAGACTCCGGCCTCTATGCTTG<br>TACTGCCAGTAGGACTGTAGACAGTGAAACTTGGTACTTCATGGTGAATGTCACAGA<br>TGCCATCTCATCCGGAGATGATGAGGATGACACCGATGGTGCGGAAGATTTTGTCAG<br>TGAGAACAGTAACAACAAGAGAGCACCATACTGGACCAACACAGAAAAGATGGAAAA<br>GCGGCTCCATGCTGTGCCTGCGGCCAACACTGTCAAGTTTCGCTGCCCAGCCGGGGG<br>GAACCCAATGCCAACCATGCGGTGGCTGAAAAACGGGAAGGAGTTTAAGCAGGAGCA<br>TCGCATTGGAGGCTACAAGGTACGAAACCAGCACTGGAGCCTCATTATGGAAAGTGT<br>GGTCCCATCTGACAAGGGAAATTATACCTGTGTAGTGGAGAATGAATACGGGTCCAT<br>CAATCACACGTACCACCTGGATGTTGTGGAGCGATCGCCTCACCGGCCCATCCTCCA<br>AGCCGGACTGCCGGCAAATGCCTCCACAGTGGTCGGAGGAGACGTAGAGTTTGTCTG<br>CAAGGTTTACAGTGATGCCCAGCCCCACATCCAGTGGATCAAGCACGTGGAAAAGAA<br>CGGCAGTAAATACGGGCCGCAGCGGGCTGCCCTACCTCAAGGTTCTCAAGCACTCGGG<br>GATAAATAGTTCCAATGCAGAAGTGCTGGCTCTGTTCAATGTGACCGAGGCGGATGC<br>TGGGGAATATATATGTAAGGTCTCCAATTATATAGGGCAGGCCAACCAGTCTGCCTG<br>GCTCACTGTCCTGCCAAAACAGCAAGCGCCTGGAAGAGAAAAGGAGATTACAGCTTC<br>CCCAGACTACCTGGAGATAGCCATTTACTGCATAGGGGTCTTCTTAATCGCCTGTAT<br>GGTGGTAACAGTCATCCTGTGCCGAATGAAGAACACGACCAAGAAGCCAGACTTCAG<br>CAGCCAGCCGGCTGTGCACAAGCTGACCAAACGTATCCCCCTGCGGAGACAGGTAAC<br>AGTTTCGGCTGAGTCCAGCTCCTCCATGAACTCCAACACCCCGCTGGTGAGGATAAC<br>AACACGCCTCTCTTCAACGGCAGACACCCCCATGCTGGCAGGGGTCTCCGAGTATGA<br>ACTTCCAGAGGACCCAAAATGGGAGTTTCCAAGAGATAAGCTGACACTGGGCAAGCC<br>CCTGGGAGAAGGTTGCTTTGGGCAAGTGGTCATGGCGGAAGCAGTGGGAATTGACAA<br>AGACAAGCCCAAGGAGGCGGTCACCGTGGCCGTGAAGATGTTAAAGATGATGCCAC<br>AGAGAAAGACCTTTCTGATCTGGTGTCAGAGATGGAGATGATGAAGATGATTGGGAA<br>ACACAAGAATATCATAAATCTTCTTGGAGCTTGCACACAGGATGGGCCTCTCTATGT<br>CATAGTTGAGTATGCCTCTAAAGGCAACCTCCGAGAATACCTCCGAGCCCGGAGGCC<br>ACCCGGGATGGAGTACTCCTATGACATTAACCGTGTTCCTGAGGAGCAGATGACCTT<br>CAAGGACTTGGTGTCATGCACCTACCAGCTGGCCAGAGGCATGGAGTACTTGGCTTC<br>CCAAAAATGTATTCATCGAGATTTAGCAGCCAGAAATGTTTTGGTAACAGAAAACAA<br>TGTGATGAAAATAGCAGACTTTGGACTCGCCAGAGATATCAACAATATAGACTATTA |

TABLE 5-continued

FGFR sequences.

|  |  |  |
|---|---|---|
|  |  | CAAAAAGACCACCAATGGGCGGCTTCCAGTCAAGTGGATGGCTCCAGAAGCCCTGTT<br>TGATAGAGTATACACTCATCAGAGTGATGTCTGGTCCTTCGGGGTGTTAATGTGGGA<br>GATCTTCACTTTAGGGGGCTCGCCCTACCCAGGGATTCCCGTGGAGGAACTTTTTAA<br>GCTGCTGAAGGAAGGACACAGAATGGATAAGCCAGCCAACTGCACCAACGAACTGTA<br>CATGATGATGAGGGACTGTTGGCATGCAGTGCCCTCCCAGAGACCAACGTTCAAGCA<br>GTTGGTAGAAGACTTGGATCGAATTCTCACTCTCACAACCAATGAGGAATACTTGGA<br>CCTCAGCCAACCTCTCGAACAGTATTCACCTAGTTACCCTGACACAAGAAGTTCTTG<br>TTCTTCAGGAGATGATTCTGTTTTTTCTCCAGACCCCATGCCTTACGAACCATGCCT<br>TCCTCAGTATCCACACATAAACGGCAGTGTTAAAACATGA |
| SEQ ID<br>NO: 34 | FGFR2<br>isoform 8<br>Amino acid<br>sequence | MVSWGRFICLVVVTMATLSLARPSFSLVEDTTLEPEEPPTKYQISQPEVYVAAPGES<br>LEVRCLLKDAAVISWTKDGVHLGPNNRTVLIGEYLQIKGATPRDSGLYACTASRTVD<br>SETWYFMVNVTDAISSGDDEDDTDGAEDFVSENSNNKRAPYWTNTEKMEKRLHAVPA<br>ANTVKFRCPAGGNPMPTMRWLKNGKEFKQEHRIGGYKVRNQHWSLIMESVVPSDKGN<br>YTCVVENEYGSINHTYHLDVVERSPHRPILQAGLPANASTVVGGDVEFVCKVYSDAQ<br>PHIQWIKHVEKNGSKYGPDGLPYLKVLKHSGINSSNAEVLALFNVTEADAGEYICKV<br>SNYIGQANQSAWLTVLPKQQAPGREKEITASPDYLEIAIYCIGVFLIACMVVTVILC<br>RMKNTTKKPDFSSQPAVHKLTKRIPLRRQVTVSAESSSSMNSNTPLVRITTRLSSTA<br>DTPMLAGVSEYELPEDPKWEFPRDKLTLGKPLGEGCFGQVVMAEAVGIDKDKPKEAV<br>TVAVKMLKDDATEKDLSDLVSEMEMMKMIGKHKNIINLLGACTQDGPLYVIVEYASK<br>GNLREYLRARRPPGMEYSYDINRVPEEQMTFKDLVSCTYQLARGMEYLASQKCIHRD<br>LAARNVLVTENNVMKIADFGLARDINNIDYYKKTTNGRLPVKWMAPEALFDRVYTHQ<br>SDVWSFGVLMWEIFTLGGSPYPGIPVEELFKLLKEGHRMDKPANCTNELYMMMRDCW<br>HAVPSQRPTFKQLVEDLDRILTLTTNEEYLDLSQPLEQYSPSYPDTRSSCSSGDDSV<br>FSPDPMPYEPCLPQYPHINGSVKT |
| SEQ ID<br>NO: 35 | FGFR2<br>isoform 9<br>Nucleic acid<br>sequence | GAGAGCCGAGCGGGCGGCGGCGGGTGCGGAGCGGGCGAGGGAGCGCGCGCGGCCGC<br>CACAAAGCTCGGGCGCCGCGGGGCTGCATGCGGCGTACCTGGCCCGGCGCGGCGACT<br>GCTCTCCGGGCTGGCGGGGGCCGGCCGCGAGCCCCGGGGGCCCCGAGGCCGCAGCTT<br>GCCTGCGCGCTCTGAGCCTTCGCAACTCGCGAGCAAAGTTTGGTGGAGGCAACGCCA<br>AGCCTGAGTCCTTTCTTCCTCGTTCCCCAAATCCGAGGGCAGCCCGCGGGCGTCA<br>TGCCCGCGCTCCTCCGCAGCCTGGGGTACGCGTGAAGCCCGGGAGGCTTGGCGCCGG<br>CGAAGACCCAAGGACCACTCTTCTGCGTTTGGAGTTGCTCCCCGCAACCCCGGGCTC<br>GTCGCTTTCTCCATCCCGACCCACGCGGGGCGCGGGGACAACACAGGTCGCGGAGGA<br>GCGTTGCCATTCAAGTGACTGCAGCAGCAGCGCAGCGCCTCGGTTCCTGAGCCCAC<br>CGCAGGCTGAAGGCATTGCGCGTAGTCCATGCCCGTAGAGGAAGTGTGCAGATGGGA<br>TTAACGTCCACATGGAGATATGGAAGAGGACCGGGGATTGGTACCGTAACCATGGTC<br>AGCTGGGGTCGTTTCATCTGCCTGGTCGTGGTCACCATGGCAACCTTGTCCCTGGCC<br>CGGCCCCTCCTTCAGTTTAGTTGAGGATACCACATTAGAGCCAGAAGATGCCATCTCA<br>TCCGGAGATGATGAGGATGACACCGATGGTGCGGAAGATTTTGTCAGTGAGACAGT<br>AACAACAAGAGAGCACCATACTGGACCAACACAGAAAAGATGGAAAAGCGGCTCCAT<br>GCTGTGCCTGCGGCCAACACTGTCAAGTTTCGCTGCCCAGCCGGGGGGAACCCAATG<br>CCAACCATGCGGTGGCTGAAAAACGGGAAGGAGTTTAAGCAGGAGCATCGCATTGGA<br>GGCTACAAGGTACGAAACCAGCACTGGAGCCTCATTATGGAAAGTGTGGTCCCATCT<br>GACAAGGGAAATTATACCTGTGTAGTGGAGAATGAATACGGGTCCATCAATCACACG<br>TACCACCTGGATGTTGTGGAGCGATCGCCTCACCGGCCCATCCTCCAAGCCGGACTG<br>CCGGCAAATGCCTCCACAGTGGTCGGAGGAGACGTAGAGTTTGTCTGCAAGGTTTAC<br>AGTGATGCCCAGCCCCACATCCAGTGGATCAAGCACGTGGAAAAGAACGGCAGTAAA<br>TACGGGCCCGACGGGCTGCCCTACCTCAAGGTTCTCAAGCACTCGGGGATAAATAGT<br>TCCAATGCAGAAGTGCTGGCTCTGTTCAATGTGACCGAGGCGGATGCTGGGGAATAT<br>ATATGTAAGGTCTCCAATTATATAGGGCAGGCCAACCAGTCTGCCTGGCTCACTGTC<br>CTGCCAAAACAGCAAGCGCCTGGAAGAGAAAAGGAGATTACAGCTTCCCCAGACTAC<br>CTGGAGATAGCCATTTACTGCATAGGGGTCTTCTTAATCGCCTGTATGGTGGTAACA<br>GTCATCCTGTGCCGAATGAAGAACACGACCAAGAAGCCAGACTTCAGCAGCCAGCCG<br>GCTGTGCACAAGCTGACCAAACGTATCCCCCTGCGGAGACAGGTAACAGTTTCGGCT<br>GAGTCCAGCTCCTCCATGAACTCCAACACCCCGCTGGTGAGGATAACAACACGCCTC<br>TCTTCAACGGCAGACACCCCCATGCTGGCAGGGGTCTCCGAGTATGAACTTCCAGAG<br>GACCCAAAATGGGAGTTTCCAAGAGATAAGCTGACACTGGGCAAGCCCCTGGGAGAA<br>GGTTGCTTTGGGCAAGTGGTCATGGCGGAAGCAGTGGGAATTGACAAAGACAAGCCC<br>AAGGAGGCGGTCACCGTGGCCGTGAAGATGTTGAAAGATGATGCCACAGAGAAAGAC<br>CTTTCTGATCTGGTGTCAGAGATGGAGATGATGAAGATGATTGGGAAACACAAGAAT<br>ATCATAAATCTTCTTGGAGCCTGCACACAGGATGGGCCTCTCTATGTCATAGTTGAG<br>TATGCCTCTAAAGGCAACCTCCGAGAATACCTCCGAGCCCGGAGGCCACCCGGGATG<br>GAGTACTCCTATGACATTAACCGTGTTCCTGAGGAGCAGATGACCTTCAAGGACTTG<br>GTGTCATGCACCTACCAGCTGGCCAGAGGCATGGAGTACTTGGCTTCCCAAAAATGT<br>ATTCATCGAGATTTAGCAGCCAGAAATGTTTTGGTAACAGAAAACAATGTGATGAAA<br>ATAGCAGACTTTGGACTCGCCAGAGATATCAACAATATAGACTATTACAAAAAGACC<br>ACCAATGGGCGGCTTCCAGTCAAGTGGATGGCTCCAGAAGCCCTGTTTGATAGAGTA<br>TACACTCATCAGAGTGATGTCTGGTCCTTCGGGGTGTTAATGTGGGAGATCTTCACT<br>TTAGGGGGCTCGCCCTACCCAGGGATTCCCGTGGAGGAACTTTTTAAGCTGCTGAAG<br>GAAGGACACAGAATGGATAAGCCAGCCAACTGCACCAACGAACTGTACATGATGATG<br>AGGGACTGTTGGCATGCAGTGCCCTCCCAGAGACCAACGTTCAAGCAGTTGGTAGAA<br>GACTTGGATCGAATTCTCACTCTCACAACCAATGAAAGTTTATGGCTTCA<br>TTGAGAAACTGGGAAAGTTGGTCAGGCGCAGTGGCTCATGCCTGTAATCCCAGCAC<br>TTTGGGAGGCCGAGGCAGGCGGATCATGAGGTCAGGAGTTCCAGACCAGCCTGGCCA<br>ACATGGTGAAACCCTGTCTCTACTAAAGATACAAAAAATTAGCCGGGCGTGTTGGTG<br>TGCACCTGTAATCCCAGCTACTCCGGGAGGCTGAGGCAGGAGAGTCACTTGAACCGG<br>GGAGGCGGAGGTTGCAGTGAGCCGAGATCATGCCATTGCATTCCAGCCTTGGCGACA |

| | | |
|---|---|---|
| | | GAGCGAGACTCCGTCTCAAAAAAAAATAAAAA |
| SEQ ID NO: 36 | FGFR2 isoform 9 Amino acid sequence | MVSWGRFICLVVVTMATLSLARPSFSLVEDTTLEPEDAISSGDDEDDTDGAEDFVSE NSNNKRAPYWTNTEKMEKRLHAVPAANTVKFRCPAGGNPMPTMRWLKNGKEFKQEHR IGGYKVRNQHWSLIMESVVPSDKGNYTCVVENEYGSINHTYHLDVVERSPHRPILQA GLPANASTVVGGDVEFVCKVYSDAQPHIQWIKHVEKNGSKYGPDGLPYLKVLKHSGI NSSNAEVLALFNVTEADAGEYICKVSNYIGQANQSAWLTVLPKQQAPGREKEITASP DYLEIAIYCIGVFLIACMVVTVILCRMKNTTKKPDFSSQPAVHKLTKRIPLRRQVTV SAESSSSMNSNTPLVRITTRLSSTADTPMLAGVSEYELPEDPKWEFPRDKLTLGKPL GEGCFGQVVMAEAVGIDKDKPKEAVTVAVKMLKDDATEKDLSDLVSEMEMMKMIGKH KNIINLLGACTQDGPLYVIVEYASKGNLREYLRARRPPGMEYSYDINRVPEEQMTFK DLVSCTYQLARGMEYLASQKCIHRDLAARNVLVTENNVMKIADPFGLARDINNIDYYK KTTNGRLPVKWMAPEALFDRVYTHQSDVWSFGVLMWEIFTLGGSPYPGIPVEELFKL LKEGHRMDKPANCTNELYMMMRDCWHAVPSQRPTFKQLVEDLDRILTLTTNEI |
| SEQ ID NO: 37 | FGFR2 isoform 10 Nucleic acid sequence | GGACCGGGGATTGGTACCGTAACCATGGTCAGCTGGGGTCGTTTCATCTGCCTGGTC GTGGTCACCATGGCAACCTTGTCCCTGGCCCGGCCCTCCTTCAGTTTAGTTGAGGAT ACCACATTAGAGCCAGAAGAGCCACCAACCCAAATACCAAATCTCTCAACCAGAAGTG TACGTGGCTGCGCCAGGGGAGTCGCTAGAGGTGCGCTGCCTGTTGAAAGATGCCGCC GTGATCAGTTGGACTAAGGATGGGGTGCACTTGGGGCCCAACAATAGGACAGTGCTT ATTGGGGAGTACTTGCAGATAAAGGGCGCCACGCCTAGAGACTCCGGCCTCTATGCT TGTACTGCCAGTAGGACTGTAGACAGTGAAACTTGGTACTTCATGGTGAATGTCACA GATGCCATCTCATCCGGAGATGATGAGGATGACACCGATGGTGCGGAAGATTTTGTC AGTGAGAACAGTAACAACAAGAGAGCACCATACTGGACCAACACAGAAAAGATGGAA AAGCGGCTCCATGCTGTGCCTGCGGCCAACACTGTCAAGTTTCGCTGCCCAGCCGGG GGGAACCCAATGCCAACCATGCGGTGGCTGAAAAACGGGAAGGAGTTTAAGCAGGAG CATCGCATTGGAGGCTACAAGGTACGAAACCAGCACTGGAGCCTCATTATGGAAAGT GTGGTCCCATCTGACAAGGGAAATTATACCTGTGTAGTGGAGAATGAATACGGGTCC ATCAATCACACGTACCACCTGGATGTTGTGGAGCGATCGCCTCACCGGCCCATCCTC AAGCCGGACTGCCGGCAAATGCCTCCACAGTGGTCGGAGGAGACGTAGAGTTTGTC TGCAAGGTTTACAGTGATGCCCAGCCCCACATCCAGTGGATCAAGCACGTGGAAAAG AACGGCAGTAAATACGGGCCCGACGGGCTGCCCTACCTCAAGGTTCTCAAGCACTCG GGGATAAATAGTTCCAATGCAGAAGTGCTGGCTCTGTTCAATGTGACCGAGGCGGAT GCTGGGGAATATATATGTAAGGTCTCCAATTATATAGGGCAGGCCAACCAGTCTGCC TGGCTCACTGTCCTGCCAAAACAGCAAGCGCCTGGAAGAGAAAAGGAGATTACAGCT TCCCCAGACTACCTGGAGATAGCCATTTACTGCATAGGGGTCTTCTTAATCGCCTGT ATGGTGGTAACAGTCATCCTGTGCCGAATGAAGAACACGACCAAGAAGCCAGACTTC AGCAGCCAGCCGGCTGTGCACAAGCTGACCAAACGTATCCCCCTGCGGAGACAGGTA ACAGTTTCGGCTGAGTCCAGCTCCTCCATGAACTCCAACACCCCGCTGGTGAGGATA ACAACACGCCTCTCTTCAACGGCAGACACCCCCATGCTGGCAGGGGTCTCCGAGTAT GAACTTCCAGAGGACCCAAAATGGGAGTTTCCAAGAGATAAGCTGACACTGGGCAAG CCCCTGGGAGAAGGTTGCTTTGGGCAAGTGGTCATGGCGGAAGCAGTGGGAATTGAC AAAGACAAGCCCAAGGAGGCGGTCACCGTGGCCGTGAAGATGTTGAAAGATGATGCC ACAGAGAAAGACCTTTCTGATCTGGTGTCAGAGATGGAGATGATGAAGATGATTGGG AAACACAAGAATATCATAAATCTTCTTGGAGCCTGCACACAGGATGGGCCTCTCTAT GTCATAGTTGAGTATGCCTCTAAAGGCAACCTCCGAGAATACCTCCGAGCCCGGAGG CCACCCGGGATGGAGTACTCCTATGACATTAACCGTGTTCCTGAGGAGCAGATGACC TTCAAGGACTTGGTGTCATGCACCTACCAGCTGGCCAGAGGCATGGAGTACTTGGCT TCCCAAAAATGTATTCATCGAGATTTAGCAGCCAGAAATGTTTTGGTAACAGAAAAC AATGTGATGAAAATAGCAGACTTTGGACTCGCCAGAGATATCAACAATATAGACTAT TACAAAAAGACCACCAATGGGCGGCTTCCAGTCAAGTGGATGGCTCCAGAAGCCCTG TTTGATAGAGTATACACTCATCAGAGTGATGTCTGGTCCTTCGGGGTGTTAATGTGG GAGATCTTCACTTTAGGGGGCTCGCCCTACCCAGGGATTCCCGTGGAGGAACTTTTT AAGCTGCTGAAGGAAGGACACAGAATGGATAAGCCAGCCAACTGCACCAACGAACTG TACATGATGATGAGGGACTGTTGGCATGCAGTGCCCTCCCAGAGACCAACGTTCAAG CAGTTGGTAGAAGACTTGGATCGAATTCTCACTCTCACAACCAATGAGATCTGAAAG TTTATGCTTCATTGAGAAACTGGGAAAGTTGGTCAGGCGCAGTGGCTCATGCCTG TAATCCCAGCACTTTGGGAGGCCGAGGCAGGCGGATCATGAGGTCAGGAGTTCCAGA CCAGCCTGGCCAACATGGTGAAACCCTGTCTCTACTAAAGATACAAAAAATTAGCCG GGCGTGTTGGTGTGCACCTGTAATCCCAGCTACTCGGGAGGCTGAGGCAGGAGAGT CACTTGAACCGGGGAGGCGGAGGTTGCAGTGAGCCGAGATCATGCCATTGCATTCCA GCCTTGGCGACAGAGCGAGACTCCGTCT |
| SEQ ID NO: 38 | FGFR2 isoform 10 Amino acid sequence | MVSWGRFICLVVVTMATLSLARPSFSLVEDTTLEPEEPPTKYQISQPEVYVAAPGES LEVRCLLKDAAVISWTKDGVHLGPNNRTVLIGEYLQIKGATPRDSGLYACTASRTVD SETWYFMVNVTDAISSGDDEDDTDGAEDFVSENSNNKRAPYWTNTEKMEKRLHAVPA ANTVKFRCPAGGNPMPTMRWLKNGKEFKQEHRIGGYKVRNQHWSLIMESVVPSDKGN YTCVVENEYGSINHTYHLDVVERSPHRPILQAGLPANASTVVGGDVEFVCKVYSDAQ PHIQWIKHVEKNGSKYGPDGLPYLKVLKHSGINSSNAEVLALFNVTEADAGEYICKV SNYIGQANQSAWLTVLPKQQAPGREKEITASPDYLEIAIYCIGVFLIACMVVTVILC RMKNTTKKPDFSSQPAVHKLTKRIPLRRQVTVSAESSSSMNSNTPLVRITTRLSSTA DTPMLAGVSEYELPEDPKWEFPRDKLTLGKPLGEGCFGQVVMAEAVGIDKDKPKEAV TVAVKMLKDDATEKDLSDLVSEMEMMKMIGKHKNI INLLGACTQDGPLYVIVEYASK GNLREYLRARRPPGMEYSYDINRVPEEQMTFKDLVSCTYQLARGMEYLASQKCIHRD LAARNVLVTENNVMKIADPFGLARDINNIDYYKKTTNGRLPVKWMAPEALFDRVYTHQ SDVWSFGVLMWEIFTLGGSPYPGIPVEELFKLLKEGHRMDKPANCTNELYMMMRDCW HAVPSQRPTFKQLVEDLDRILTLTTNEI |

TABLE 5-continued

| | | FGFR sequences. |
|---|---|---|
| SEQ ID NO: 39 | FGFR2 isoform 11 Nucleic acid sequence | GGTACCGTAACCATGGTCAGCTGGGGTCGTTTCATCTGCCTGGTCGTGGTCACCATG GCAACCTTGTCCCTGGCCCGGCCCTCCTTCAGTTTAGTTGAGGATACCACATTAGAG CCAGAAGAGCCACCAACCAAATACCAAATCTCTCAACCAGAAGTGTACGTGGCTGCG CCAGGGGAGTCGCTAGAGGTGCGCTGCCTGTTGAAAGATGCCGCCGTGATCAGTTGG ACTAAGGATGGGGTGCACTTGGGGCCCAACAATAGGACAGTGCTTATTGGGGAGTAC TTGCAGATAAAGGGCGCCACGCCTAGAGACTCCGGCCTCTATGCTTGTACTGCCAGT AGGACTGTAGACAGTGAAACTTGGTACTTCATGGTGAATGTCACAGATGCCATCTCA TCCGGAGATGATGAGGATGACACCGATGGTGCGGAAGATTTTGTCAGTGAGAACAGT AACAACAAGAGAGCACCATACTGGACCAACACAGAAAAGATGGAAAAGCGGCTCCAT GCTGTGCCTGCGGCCAACACTGTCAAGTTTCGCTGCCCAGCCGGGGGGAACCCAATG CCAACCATGCGGTGGCTGAAAAACGGGAAGGAGTTTAAGCAGGAGCATCGCATTGGA GGCTACAAGGTACGAAACCAGCACTGGAGCCTCATTATGGAAAGTGTGGTCCCATCT GACAAGGGAAATTATACCTGTGTAGTGGAGAATGAATACGGGTCCATCAATCACACG TACCACCTGGATGTTGTGGAGCGATCGCCTCACCGGCCCATCCTCCAAGCGGACTG CCGGCAAATGCCTCCACAGTGGTCGGAGGAGACGTAGAGTTTGTCTGCAAGGTTTAC AGTGATGCCCAGCCCCACATCCAGTGGATCAAGCACGTGGAAAAGAACGGCAGTAAA TACGGGCCCGACGGGCTGCCCTACCTCAAGGTTCTCAAGGCCGCCGGTGTTAACACC ACGGACAAAGAGATTGAGGTTCTCTATATTCGGAATGTAACTTTTGAGGACGCTGGG GAATATACGTGCTTGGCGGGTAATTCTATTGGGATATCCTTTCACTCTGCATGGTTG ACAGTTCTGCCAGCGCCTGGAAGAGAAAAGGAGATTACAGCTTCCCCAGACTACCTG GAGATAGCCATTTACTGCATAGGGGTCTTCTTAATCGCCTGTATGGTGGTAACAGTC ATCCTGTGCCGAATGAAGAACACGACCAAGAAGCCAGACTTCAGCAGCCAGCCGGCT GTGCACAAGCTGACCAAACGTATCCCCCTGCGGAGACAGGTTTCGGCTGAGTCCAGC TCCTCCATGAACTCCAACACCCCGCTGGTGAGGATAACAACACGCCTCTCTTCAACG GCAGACACCCCCATGCTGGCAGGGGTCTCCGAGTATGAACTTCCAGAGGACCCAAAA TGGGAGTTTCCAAGAGATAAGCTGACACTGGGCAAGCCCCTGGGAGAAGGTTGCTTT GGGCAAGTGGTCATGGCGGAAGCAGTGGGAATTGACAAAGACAAGCCCAAGGAGGCG GTCACCGTGGCCGTGAAGATGTTGAAAGATGATGCCACAGAGAAAGACCTTTCTGAT CTGGTGTCAGAGATGGAGATGATGAAGATGATTGGGAAACACAAGAATATCATAAAT CTTCTTGGAGCCTGCACACAGGATGGGCCTCTCTATGTCATAGTTGAGTATGCCTCT AAAGGCAACCTCCGAGAATACCTCCGAGCCCGGAGGCCACCCGGGATGGAGTACTCC TATGACATTAACCGTGTTCCTGAGGAGCAGATGACCTTCAAGGACTTGGTGTCATGC ACCTACCAGCTGGCCAGAGGCATGGAGTACTTGGCTTCCCAAAAATGTATTCATCGA GATTTAGCAGCCAGAAATGTTTTGGTAACAGAAAACAATGTGATGAAAATAGCAGAC TTTGGACTCGCCAGAGATATCAACAATATAGACTATTACAAAAAGACCACCAATGGG CGGCTTCCAGTCAAGTGGATGGCTCCAGAAGCCCTGTTTGATAGAGTATACACTCAT CAGAGTGATGTCTGGTCCTTCGGGGTGTTAATGTGGGAGATCTTCACTTTAGGGGGC TCGCCCTACCCAGGGATTCCCGTGGAGGAACTTTTTAAGCTGCTGAAGGAAGGACAC AGAATGGATAAGCCAGCCAACTGCACCAACGAACTGTACATGATGATGAGGGACTGT TGGCATGCAGTGCCCTCCCAGAGACCAACGTTCAAGCAGTTGGTAGAAGACTTGGAT CGAATTCTCACTCTCACAACCAATGAGGAATACTTGGACCTCAGCCAACCTCTCGAA CAGTATTCACCTAGTTACCCTGACACAAGAAGTTCTTGTTCTTCAGGAGATGATTCT GTTTTTTCTCCAGACCCCATGCCTTACGAACCATGCCTTCCTCAGTATCCACACATA AACGGCAGTGTTAAAACATGA |
| SEQ ID NO: 40 | FGFR2 isoform 11 Amino acid sequence | MVSWGRFICLVVVTMATLSLARPSFSLVEDTTLEPEEPPTKYQISQPEVYVAAPGES LEVRCLLKDAAVISWTKDGVHLGPNNRTVLIGEYLQIKGATPRDSGLYACTASRTVD SETWYFMVNVTDAISSGDDEDDTDGAEDFVSENSNNKRAPYWTNTEKMEKRLHAVPA ANTVKFRCPAGGNPMPTMRWLKNGKEFKQEHRIGGYKVRNQHWSLIMESVVPSDKGN YTCVVENEYGSINHTYHLDVVERSPHRPILQAGLPANASTVVGGDVEFVCKVYSDAQ PHIQWIKHVEKNGSKYGPDGLPYLKVLKAAGVNTTDKEIEVLYIRNVTFEDAGEYTC LAGNSIGISFHSAWLTVLPAPGREKEITASPDYLEIAIYCIGVFLIACMVVTVILCR MKNTTKKPDFSSQPAVHKLTKRIPLRRQVSAESSSSMNSNTPLVRITTRLSSTADTP MLAGVSEYELPEDPKWEFPRDKLTLGKPLGEGCFGQVVMAEAVGIDKDKPKEAVTVA VKMLKDDATEKDLSDLVSEMEMMKMIGKHKNIINLLGACTQDGPLYVIVEYASKGNL REYLRARRPPGMEYSYDINRVPEEQMTFKDLVSCTYQLARGMEYLASQKCIHRDLAA RNVLVTENNVMKIADFGLARDINNIDYYKKTTNGRLPVKWMAPEALFDRVYTHQSDV WSFGVLMWEIFTLGGSPYPGIPVEELFKLLKEGHRMDKPANCTNELYMMMRDCWHAV PSQRPTFKQLVEDLDRILTLTTNEEYLDLSQPLEQYSPSYPDTRSSCSSGDDSVFSP DPMPYEPCLPQYPHINGSVKT |
| SEQ ID NO: 41 | FGFR3 isoform 1 Nucleic acid sequence | AGTGCGCGGTGGCGGCGGCGTCGCGGGCAGCTGGCGCCGCGCGGTCCTGCTCTGCCG GTCGCACGGACGCACCGGCGGGCCGCCGGCCGGAGGGACGGGGCGGGAGCTGGGCCC GCGGACAGCGGAGCCGGAGCGGGAGCCGCGCGTAGCGAGCCGGGCTCCGGCGCTCGC AGTCTCCCGAGCGGCGCCCGCCTCCCGCCGGTGCCCGCGCCGGGCCCGTGGGGGCGA CATGCCCGCGCGCTGCCTGAGGACGCGCGCCCCGCCCCCGCCATGGGCGCCC CTGCCTGCGCCCTCGCGCTCTGCGTGGCCGTGGCCATCGTGGCCGGCGCCTCCTCGG AGTCCTTGGGGACGGAGCAGCGCGTCGTGGGCGAGCGGCAGAAGTCCCGGGCCCAG AGCCCGGCCAGCAGGAGCAGTTGGTCTTCGGCAGCGGGGATGCTGTGGAGCTGAGCT GTCCCCCGCCCGGGGTGGTCCCATGGGGCCCACTGTCTGGGTCAAGGATGGCACAG GGCTGGTGCCCTCGGAGCGTGTCCTGGTGGGGCCCCAGCGGCTGCAGGTGCTGAATG CCTCCCACGAGGACTCCGGGGCCTACAGCTGCCGGCAGCGGCTCACGCAGCGCGTAC TGTGCCACTTCAGTGTGCGGGTGACAGACGCTCCATCCTCGGGAGATGACGAAGACG GGGAGGACGAGGCTGAGGACACAGGTGTGGACACAGGGGCCCCTTACTGGACACGGC CCGAGCGGATGGACAAGAAGCTGCTGGCCGTGCCGGCCGCCAACACCGTCCGCTTCC GCTGCCCAGCCGCTGGCAACCCCACTCCCTCCATCTCCTGGCTGAAGAACGGCAGGG AGTTCCGCGGCGAGCACCGCATTGGAGGCATCAAGCTGCGGCATCAGCAGTGGAGCC TGGTCATGGAAAGCGTGGTGCCCTCGGACCGCGGCAACTACACCTGCGTCGTGGAGA |

TABLE 5-continued

FGFR sequences.

|  |  |  |
|---|---|---|
|  |  | ACAAGTTTGGCAGCATCCGGCAGACGTACACGCTGGACGTGCTGGAGCGCTCCCCGC<br>ACCGGCCCATCCTGCAGGCGGGGCTGCCGGCCAACCAGACGGCGGTGCTGGGCAGCG<br>ACGTGGAGTTCCACTGCAAGGTGTACAGTGACGCACAGCCCCACATCCAGTGGCTCA<br>AGCACGTGGAGGTGAATGGCAGCAAGGTGGGCCCGGACGGCACACCCTACGTTACCG<br>TGCTCAAGACGGCGGGCGCTAACACCACCGACAAGGAGCTAGAGGTTCTCTCCTTGC<br>ACAACGTCACCTTTGAGGACGCCGGGGAGTACACCTGCCTGGCGGGCAATTCTATTG<br>GGTTTTCTCATCACTCTGCGTGGCTGGTGGTGCTGCCAGCCGAGGAGGAGCTGGTGG<br>AGGCTGACGAGGCGGGCAGTGTGTATGCAGGCATCCTCAGCTACGGGGTGGGCTTCT<br>TCCTGTTCATCCTGGTGGTGGCGGCTGTGACGCTCTGCCGCCTGCGCAGCCCCCCA<br>AGAAAGGCCTGGGCTCCCCCACCGTGCACAAGATCTCCCGCTTCCCGCTCAAGCGAC<br>AGGTGTCCCTGGAGTCCAACGCGTCCATGAGCTCCAACACACCACTGGTGCGCATCG<br>CAAGGCTGTCCTCAGGGGAGGGCCCCACGCTGGCCAATGTCTCCGAGCTCGAGCTGC<br>CTGCCGACCCCAAATGGGAGCTGTCTCGGGCCCGGCTGACCCTGGGCAAGCCCCTTG<br>GGGAGGGCTGCTTCGGCCAGGTGGTCATGGCGGAGGCCATCGGCATTGACAAGGACC<br>GGGCCGCCAAGCCTGTCACCGTAGCCGTGAAGATGCTGAAAGACGATGCCACTGACA<br>AGGACCTGTCGGACCTGGTGTCTGAGATGGAGATGATGAAGATGATCGGGAAACACA<br>AAAACATCATCAACCTGCTGGGCGCCTGCACGCAGGGCGGGCCCCTGTACGTGCTGG<br>TGGAGTACGCGGCCAAGGGTAACCTGCGGGAGTTTCTGCGGGCGCGGCGGCCCCCGG<br>GCCTGGACTACTCCTTCGACACCTGCAAGCCGCCCGAGGAGCAGCTCACCTTCAAGG<br>ACCTGGTGTCCTGTGCCTACCAGGTGGCCCGGGGCATGGAGTACTTGGCCTCCCAGA<br>AGTGCATCCACAGGGACCTGGCTGCCCGCAATGTGCTGGTGACCGAGGACAACGTGA<br>TGAAGATCGCAGACTTCGGGCTGGCCCGGGACGTGCACAACCTCGACTACTACAAGA<br>AGACGACCAACGGCCGGCTGCCCGTGAAGTGGATGGCGCCTGAGGCCTTGTTTGACC<br>GAGTCTACACTCACCAGAGTGACGTCTGGTCCTTTGGGGTCCTGCTCTGGGAGATCT<br>TCACGCTGGGGGGCTCCCCGTACCCCGGCATCCCTGTGGAGGAGCTCTTCAAGCTGC<br>TGAAGGAGGGCCACCGCATGGACAAGCCCGCCAACTGCACACACGACCTGTACATGA<br>TCATGCGGGAGTGCTGGCATGCCGCGCCCTCCCAGAGGCCCACCTTCAAGCAGCTGG<br>TGGAGGACCTGGACCGTGTCCTTACCGTGACGTCCACCGACGAGTACCTGGACCTGT<br>CGGCGCCTTTCGAGCAGTACTCCCCGGGTGGCCAGGACACCCCCAGCTCCAGCTCCT<br>CAGGGGACGACTCCGTGTTTGCCCACGACCTGCTGCCCCCGGCCCCACCCAGCAGTG<br>GGGGCTCGCGGACGTGAAGGGCCACTGGTCCCAACAATGTGAGGGGTCCCTAGCAG<br>CCCACCCTGCTGCTGGTGCACAGCCACTCCCCGGCATGAGACTCAGTGCAGATGGAG<br>AGACAGCTACACAGAGCTTTGGTCTGTGTGTGTGTGTGCGTGTGTGTGTGTGT<br>GTGCACATCCGCGTGTGCCTGTGCGTGCGCATCTTGCCTCCAGGTGCAGAGGTAC<br>CCTGGGTGTCCCCGCTGCTGTGCAACGGTCTCCTGACTGGTGCTGCAGCACCGAGGG<br>GCCTTTGTTCTGGGGGGACCCAGTGCAGAATGTAAGTGGGCCCACCCGGTGGGACCC<br>CCGTGGGCAGGGAGCTGGGCCCGACATGGCTCCGGCCTCTGCCTTTGCACCACGGG<br>ACATCACAGGGTGGGCCTCGGCCCCTCCCACACCCAAAGCTGAGCCTGCAGGGAAGC<br>CCCACATGTCCAGCACCTTGTGCCTGGGGTGTTAGTGGCACCGCCTCCCCACCTCCA<br>GGCTTTCCCACTTCCCACCCTGCCCCTCAGAGACTGAAATTACGGGTACCTGAAGAT<br>GGGAGCCTTTACCTTTTATGCAAAAGGTTTATTCCGGAAACTAGTGTACATTTCTAT<br>AAATAGATGCTGTGTATATGGTATATATACATATATATATATAACATATATGGAAGA<br>GGAAAAGGCTGGTACAACGGAGGCCTGCGACCCTGGGGGCACAGGAGGCAGGCATGG<br>CCCTGGGCGGGGCGTGGGGGGCGTGGAGGGAGGCCCCAGGGGGTCTCACCCATGCA<br>AGCAGAGGACCAGGGCCTTTTCTGGCACCGCAGTTTTGTTTTAAAACTGGACCTGTA<br>TATTTGTAAAGCTATTTATGGGCCCCTGGCACTCTTGTTCCCACACCCCAACACTTC<br>CAGCATTTAGCTGGCCACATGGCGGAGAGTTTTAATTTTTAACTTATTGACAACCGA<br>GAAGGTTTATCCCGCCGATAGAGGGACGGCCAAGAATGTACGTCCAGCCTGCCCCGG<br>AGCTGGAGGATCCCCTCCAAGCCTAAAAGGTTGTTAATAGTTGGAGGTGATTCCAGT<br>GAAGATATTTTATTTCCTTTGTCCTTTTTCAGGAGAATTAGATTTCTATAGGATTTT<br>TCTTTAGGAGATTTATTTTTTGGACTTCAAAGCAAGCTGGTATTTTCATACAAATTC<br>TTCTAATTGCTGTGTCCCAGGCAGGGAGACGGTTTCCAGGGAGGGGCCGGCCCTG<br>TGTGCAGGTTCCGATGTTATTAGATGTTACAAGTTTATATATATCTATATATATAAT<br>TTATTGAGTTTTTACAAGATGTATTTGTTGTAGACTTAACACTTCTTACGCAATGCT<br>TCTAGAGTTTTATAGCCTGGACTGCTACCTTTCAAAGCTTGGAGGGAAGCCGTGAAT<br>TCAGTTGGTTCGTTCTGTACTGTTACTGGGCCTGAGTCTGGGCAGCTGTCCCTTGC<br>TTGCCTGCAGGGCCATGGCTCAGGGTGGTCTCTTCTTGGGGCCCAGTGCATGGTGGC<br>CAGAGGTGTCACCCAAACCGGCAGGTGCGATTTTGTTAACCCAGCGACGAACTTTCC<br>GAAAAATAAAGACACCTGGTTGCTAACCTGG |
| SEQ ID<br>NO: 42 | FGFR3<br>isoform 1<br>Amino acid<br>sequence | MGAPACALALCVAVAIVAGASSESLGTEQRVVGRAAEVPGPEPGQQEQLVFGSGDAV<br>ELSCPPPGGGPMGPTVWVKDGTGLVPSERVLVGPQRLQVLNASHEDSGAYSCRQRLT<br>QRVLCHFSVRVTDAPSSGDDEDGEDEAEDTGVDTGAPYWTRPERMDKKLLAVPAANT<br>VRFRCPAAGNPTPSISWLKNGREFRGEHRIGGIKLRHQQWSLVMESVVPSDRGNYTC<br>VVENKFGSIRQTYTLDVLERSPHRPILQAGLPANQTAVLGSDVEFHCKVYSDAQPHI<br>QWLKHVEVNGSKVGPDGTPYVTVLKTAGANTTDKELEVLSLHNVTFEDAGEYTCLAG<br>NSIGFSHHSAWLVVLPAEEELVEADEAGSVYAGILSYGVGFFLPILVVAAVTLCRLR<br>SPPKKGLGSPTVHKISRFPLKRQVSLESNASMSSNTPLVRIARLSSGEGPTLANVSE<br>LELPADPKWELSRARLTLGKPLGEGCFGQVVMAEAIGIDKDRAAKPVTVAVKMLKDD<br>ATDKDLSDLVSEMEMMKMIGKHKNIINLLGACTQGGPLYVLVEYAAKGNLREFLRAR<br>RPPGLDYSFDTCKPPEEQLTFKDLVSCAYQVARGMEYLASQKCIHRDLAARNVLVTE<br>DNVMKIADFGLARDVHNLDYYKKTTNGRLPVKWMAPEALFDRVYTHQSDVWSFGVLL<br>WEIFTLGGSPYPGIPVEELFKLLKEGHRMDKPANCTHDLYMIMRECWHAAPSQRPTF<br>KQLVEDLDRVLTVTSTDEYLDLSAPFEQYSPGGQDTPSSSSSGDDSVFAHDLLPPAP<br>PSSGGSRT |
| SEQ ID<br>NO: 43 | FGFR3<br>isoform 2 | GTCGCGGGCAGCTGGCGCCGCGCGGTCCTGCTCTGCCGGTCGCACGGACGCACCGGC<br>GGGCCGCCGGCCCGGAGGGACGGGGCGGGAGCTGGGCCCGCGGACAGCGAGCCGGAGC |

TABLE 5-continued

FGFR sequences.

|  |  |  |
|---|---|---|
|  | Nucleic acid sequence | GGGAGCCGCGCGTAGCGAGCCGGGCTCCGGCGCTCGCCAGTCTCCCGAGCGGCGCCC
GCCTCCCGCCGGTGCCCGCGCCGGGCCGTGGGGGGCAGCATGCCCGCGCGCGCTGCC
TGAGGACGCCGCGGCCCCCGCCCCCGCCATGGGCGCCCCTGCCTGCGCCCTCGCGCT
CTGCGTGGCCGTGGCCATCGTGGCCGGCGCCTCCTCGGAGTCCTTGGGGACGGAGCA
GCGCGTCGTGGGGCGAGCGGCAGAAGTCCCGGGCCCAGAGCCCGGCCAGCAGGAGCA
GTTGGTCTTCGGCAGCGGGGATGCTGTGGAGCTGAGCTGTCCCCCGCCCGGGGGGTGG
TCCCATGGGGCCCACTGTCTGGGTCAAGGATGGCACAGGGCTGGTGCCCTCGGAGCG
TGTCCTGGTGGGGCCCCAGCGGCTGCAGGTGCTGAATGCCTCCCACGAGGACTCCGG
GGCCTACAGCTGCCGGCAGCGGCTCACGCAGCGCGTACTGTGCCACTTCAGTGTGCG
GGTGACAGACGCTCCATCCTCGGGAGATGACGAAGACGGGGAGGACGAGGCTGAGGA
CACAGGTGTGGACACAGGGGCCCCTTACTGGACACGGCCCGAGCGGATGGACAAGAA
GCTGCTGGCCGTGCCGGCCGCCAACACCGTCCGCTTCCGCTGCCCAGCCGCTGGCAA
CCCCACTCCCTCCATCTCCTGGCTGAAGAACGGCAGGGAGTTCCGCGGCGAGCACCG
CATTGGAGGCATCAAGCTGCGGCATCAGCAGTGGAGCCTGGTCATGGAAAGCGTGGT
GCCCTCGGACCGCGGCAACTACACCTGCGTCGTGGAGAACAAGTTTGGCAGCATCCG
GCAGACGTACACGCTGGACGTGCTGGAGCGCTCCCCGCACCGGCCCATCCTGCAGGC
GGGGCTGCCGGCCAACCAGACGGCGGTGCTGGGCAGCGACGTGGAGTTCCACTGCAA
GGTGTACAGTGACGCACAGCCCCACATCCAGTGGCTCAAGCACGTGGAGGTGAATGG
CAGCAAGGTGGGCCCGGACGGCACACCCTACGTTACCGTGCTCAAGTCCTGGATCAG
TGAGAGTGTGGAGGCCGACGTGCGCCTCCGCCTGGCCAATGTGTCGGAGCGGGACGG
GGGCGAGTACCTCTGTCGAGCCACCAATTTCATAGGCGTGGCCGAGAAGGCCTTTTG
GCTGAGCGTTCACGGGCCCCGAGCAGCCGAGGAGGAGCTGGTGGAGGCTGACGAGGC
GGGCAGTGTGTATGCAGGCATCCTCAGCTACGGGGTGGGCTTCTTCCTGTTCATCCT
GGTGGTGGCGGCTGTGACGCTCTGCCGCCTGCGCAGCCCCCCCAAGAAAGGCCTGGG
CTCCCCCACCGTGCACAAGATCTCCCGCTTCCCGCTCAAGCGACAGGTGTCCCTGGA
GTCCAACGCGTCCATGAGCTCCAACACACCACTGGTGCGCATCGCAAGGCTGTCCTC
AGGGGAGGGCCCCACGCTGGCCAATGTCTCCGAGCTCGAGCTGCCTGCCGACCCCAA
ATGGGAGCTGTCTCGGGCCCGGCTGACCCTGGGCAAGCCCCTTGGGGAGGGCTGCTT
CGGCCAGGTGGTCATGGCGGAGGCCATCGGCATTGACAAGGACCGGGCCGCCAAGCC
TGTCACCGTAGCCGTGAAGATGCTGAAAGACGATGCCACTGACAAGGACCTGTCGGA
CCTGGTGTCTGAGATGGAGATGATGAAGATGATCGGGAAACACAAAAACATCATCAA
CCTGCTGGGCGCCTGCACGCAGGGCGGGCCCCTGTACGTGCTGGTGGAGTACGCGGC
CAAGGGTAACCTGCGGGAGTTTCTGCGGGCGCGGCGGCCCCCGGGCCTGGACTACTC
CTTCGACACCTGCAAGCCGCCCGAGGAGCAGCTCACCTTCAAGGACCTGGTGTCCTG
TGCCTACCAGGTGGCCCGGGGCATGGAGTACTTGGCCTCCCAGAAGTGCATCCACAG
GGACCTGGCTGCCCGCAATGTGCTGGTGACCGAGGACAACGTGATGAAGATCGCGGA
CTTCGGGCTGGCCCGGGACGTGCACAACCTCGACTACTACAAGAAGACGACCAACGG
CCGGCTGCCCGTGAAGTGGATGGCGCCTGAGGCCTTGTTTGACCGAGTCTACACTCA
CCAGAGTGACGTCTGGTCCTTTGGGGTCCTGCTCTGGGAGATCTTCACGCTGGGGGG
CTCCCCGTACCCCGGCATCCCTGTGGAGGAGCTCTTCAAGCTGCTGAAGGAGGGCCA
CCGCATGGACAAGCCCGCCAACTGCACACACGACCTGTACATGATCATGCGGGAGTG
CTGGCATGCCGCGCCCTCCCAGAGGCCCACCTTCAAGCAGCTGGTGGAGGACCTGGA
CCGTGTCCTTACCGTGACGTCCACCGACGAGTACCTGGACCTGTCGGCGCCTTTCGA
GCAGTACTCCCCGGGTGGCCAGGACACCCCAGCTCCAGCTCCTCAGGGGACGACTC
CGTGTTTGCCCACGACCTGCTGCCCCCGGCCCCACCCAGCAGTGGGGGCTCGCGGAC
GTGAAGGGCCACTGGTCCCAACAATGTGAGGGGTCCCTAGCAGCCCACCCTGCTGC
TGGTGCACAGCCACTCCCCGGCATGAGACTCAGTGCAGATGGAGAGACAGCTACACA
GAGCTTTGGTCTGTGTGTGTGTGTGTGCGTGTGTGTGTGTGTGCACATCCGCG
TGTGCCTGTGTGCGTGCGCATCTTGCCTCCAGGTGCAGAGGTACCCTGGGTGTCCCC
GCTGCTGTGCAACGGTCCTGACTGGTGCTGCAGCACCGAGGGGCCTTTGTTCTGG
GGGGACCCAGTGCAGAATGTAAGTGGGCCCACCCGGTGGGACCCCCGTGGGCAGGG
AGCTGGGCCCGACATGGCTCCGGCCTCTGCCTTTGCACCCACGGGACATCACAGGGTG
GGCCTCGGCCCCTCCCACACCCAAAGCTGAGCCTGCAGGGAAGCCCCACATGTCCAG
CACCTTGTGCCTGGGGTGTTAGTGGCACCGCCTCCCCACCTCCAGGCTTTCCCACTT
CCCACCCTGCCCCTCAGAGACTGAAATTACGGGTACCTGAAGATGGGAGCCTTTACC
TTTTATGCAAAAGGTTTATTCCGGAAACTAGTGTACATTTCTATAAATAGATGCTGT
GTATATGGTATATATACATATATATATATAACATATATGGAAGAGGAAAAGGCTGGT
ACAACGGAGGCCTGCGACCCTGGGGGCACAGGAGGCAGGCATGGCCCTGGGCGGGGC
GTGGGGGGCGTGGAGGGAGGCCCCAGGGGGTCTCACCCATGCAAGCAGAGGACCAG
GGCCTTTTCTGGCACCGCAGTTTTGTTTTAAAACTGGACCTGTATATTTGTAAAGCT
ATTTATGGGCCCCTGGCACTCTTGTTCCCACACCCCAACACTTCCAGCATTTAGCTG
GCCACATGGCGGAGAGTTTTAATTTTTAACTTATTGACAACCGAGAAGGTTTATCCC
GCCGATAGAGGGACGGCCAAGAATGTACGTCCAGCCTGCCCCGGAGCTGGAGGATCC
CCTCCAAGCCTAAAAGGTTGTTAATAGTTGGAGGTGATTCCAGTGAAGATATTTTAT
TTCCTTTGTCCTTTTCAGGAGAATTAGATTTCTATAGGATTTTTTCTTTAGGAGATT
TATTTTTTGGACTTCAAAGCAAGCTGGTATTTTCATACAAATTCTTCTAATTGCTGT
GTGTCCCAGGCAGGGAGACGGTTTCCAGGGAGGGGCCGGCCCTGTGTGCAGGTTCCG
ATGTTATTAGATGTTACAAGTTTATATATATCTATATATATAAATTTATTGAGTTTTT
ACAAGATGTATTTGTTGTAGACTTAACACTTCTTACGCAATGCTTCTAGAGTTTTAT
AGCCTGGACTGCTACCTTTCAAAGCTTGGAGGGAAGCCGTGAATTCAGTTGGTTCGT
TCTGTACTGTTACTGGGCCCTGAGTCTGGGCAGCTGTCCCTTGCTTGCCTGCAGGGC
CATGGCTCAGGGTGGTCTCTTCTTGGGGCCCAGTGCATGGTGGCCAGAGGTGTCACC
CAAACCGGCAGGTGCGATTTGTTAACCCAGCGACGAACTTTCCGAAAAATAAAGAC
ACCTGGTTGCTAACCTGG |
| SEQ ID NO: 44 | FGFR3 isoform 2 Amino acid | MGAPACALALCVAVAIVAGASSESLGTEQRVVGRAAEVPGPEPGQQEQLVFGSGDAV
ELSCPPPGGGPMGPTVWVKDGTGLVPSERVLVGPQRLQVLNASHEDSGAYSCRQRLT
QRVLCHFSVRVTDAPSSGDDEDGEDEAEDTGVDTGAPYWTRPERMDKKLLAVPAANT |

TABLE 5-continued

FGFR sequences.

| | | |
|---|---|---|
| | sequence | VRFRCPAAGNPTPSISWLKNGREFRGEHRIGGIKLRHQQWSLVMESVVPSDRGNYTC VVENKFGSIRQTYTLDVLERSPHRPILQAGLPANQTAVLGSDVEFHCKVYSDAQPHI QWLKHVEVNGSKVGPDGTPYVTVLKSWISESVEADVRLRLANVSERDGGEYLCRATN FIGVAEKAFWLSVHGPRAAEEELVEADEAGSVYAGILSYGVGFFLFILVVAAVTLCR LRSPPKKGLGSPTVHKISRFPLKRQVSLESNASMSSNTPLVRIARLSSGEGPTLANV SELELPADPKWELSRARLTLGKPLGEGCFGQVVMAEAIGIDKDRAAKPVTVAVKMLK DDATDKDLSDLVSEMEMMKMIGKHKNIINLLGACTQGGPLYVLVEYAAKGNLREFLR ARRPPGLDYSFDTCKPPEEQLTFKDLVSCAYQVARGMEYLASQKCIHRDLAARNVLV TEDNVMKIADFGLARDVHNLDYYKKTTNGRLPVKWMAPEALFDRVYTHQSDVWSFGV LLWEIFTLGGSPYPGIPVEELFKLLKEGHRMDKPANCTHDLYMIMRECWHAAPSQRP TFKQLVEDLDRVLTVTSTDEYLDLSAPFEQYSPGGQDTPSSSSSGDDSVFAHDLLPP APPSSGGSRT |
| SEQ ID NO: 45 | FGFR3 isoform 3 Nucleic acid sequence | GTCGCGGGCAGCTGGCGCCGCGCGGTCCTGCTCTGCCGGTCGCACGGACGCACCGGC GGGCCGCCGGCCGGAGGGACGGGGCGGAGCTGGGCCCGCGGACAGCGAGCCGGAGC GGGAGCCGCGCGTAGCGAGCCGGGCTCCGCGCTCGCCAGTCTCCCGAGCGGCGCCC GCCTCCCGCCGGTGCCCGCGCCGGGCCGTGGGGGGCAGCATGCCCGCGCGCGCTGCC TGAGGACGCCGCGGCCCCGCCCCCGCCATGGGCGCCCCTGCCTGCGCCCTCGCGCT CTGCGTGGCCGTGGCCATCGTGGCCGGCGCCTCCTCGGAGTCCTTGGGGACGGAGCA GCGCGTCGTGGGGCGAGCGGCAGAAGTCCCGGGCCCAGAGCCCGGCCAGCAGGAGCA GTTGGTCTTCGGCAGCGGGGATGCTGTGGAGCTGAGCTGTCCCCCGCCCGGGGGTGG TCCCATGGGGCCCACTGTCTGGGTCAAGGATGGCACAGGGCTGGTGCCCTCGGAGCG TGTCCTGGTGGGGCCCCAGCGGCTGCAGGTGCTGAATGCCTCCCACGAGGACTCCGG GGCCTACAGCTGCCGGCAGCGGCTCACGCAGCGCGTACTGTGCCACTTCAGTGTGCG GGTGACAGACGCTCCATCCTCGGGAGATGACGAAGACGGGGAGGACGAGGCTGAGGA CACAGGTGTGGACACAGGGGCCCCTTACTGGACACGGCCCGAGCGGATGGACAAGAA GCTGCTGGCCGTGCCGGCCGCCAACACCGTCCGCTTCCGCTGCCCAGCCGCTGGCAA CCCCACTCCCTCCATCTCCTGGCTGAAGAACGGCAGGGAGTTCCGCGGCGAGCACCG CATTGGAGGCATCAAGCTGCGGCATCAGCAGTGGAGCCTGGTCATGGAAAGCGTGGT GCCCTCGGACCGCGGCAACTACACCTGCGTCGTGGAGAACAAGTTTGGCAGCATCCG GCAGACGTACACGCTGGACGTGCTGGAGCGCTCCCCGCACCGGCCCATCCTGCAGGC GGGGCTGCCGGCCAACCAGACGGCGGTGCTGGGCAGCGACGTGGAGTTCCACTGCAA GGTGTACAGTGACGCACAGCCCCACATCCAGTGGCTCAAGCACGTGGAGGTGAATGG CAGCAAGGTGGGCCCGGACGGCACACCCTACGTTACCGTGCTCAAGGTGTCCCTGGA GTCCAACGCGTCCATGAGCTCCAACACACCACTGGTGCGCATCGCAAGGCTGTCCTC AGGGGAGGGCCCCACGCTGGCCAATGTCTCCGAGCTCGAGCTGCCTGCCGACCCCAA ATGGGAGCTGTCTCGGGCCCGGCTGACCCTGGGCAAGCCCCTTGGGGAGGGCTGCTT CGGCCAGGTGGTCATGGCGGAGGCCATCGGCATTGACAAGGACCGGGCCGCCAAGCC TGTCACCGTAGCCGTGAAGATGCTGAAAGACGATGCCACTGACAAGGACCTGTCGGA CCTGGTGTCTGAGATGGAGATGATGAAGATGATCGGGAAACACAAAAACATCATCAA CCTGCTGGGCGCCTGCACGCAGGGCGGGCCCCTGTACGTGCTGGTGGAGTACGCGGC CAAGGGTAACCTGCGGGAGTTTCTGCGGGCGCGGCGGCCCCCGGGCCTGGACTACTC CTTCGACACCTGCAAGCCGCCCGAGGAGCAGCTCACCTTCAAGGACCTGGTGTCCTG TGCCTACCAGGTGGCCCGGGGCATGGAGTACTTGGCCTCCCAGAAGTGCATCCACAG GGACCTGGCTGCCCGCAATGTGCTGGTGACCGAGGACAACGTGATGAAGATCGCAGA CTTCGGGCTGGCCCGGGACGTGCACAACCTCGACTACTACAAGAAGACGACCAACGG CCGGCTGCCCGTGAAGTGGATGGCGCCTGAGGCCTTGTTTGACCGAGTCTACACTCA CCAGAGTGACGTCTGGTCCTTTGGGGTCCTGCTCTGGGAGATCTTCACGCTGGGGGG CTCCCCGTACCCCGGCATCCCTGTGGAGGAGCTCTTCAAGCTGCTGAAGGAGGGCCA CCGCATGGACAAGCCCGCCAACTGCACACACGACCTGTACATGATCATGCGGGAGTG CTGGCATGCCGCGCCCTCCCAGAGGCCCACCTTCAAGCAGCTGGTGGAGGACCTGGA CCGTGTCCTTACCGTGACGTCCACCGACGAGTACCTGGACCTGTCGGCGCCTTTCGA GCAGTACTCCCCGGGTGGCCAGGACACCCCCAGCTCCAGCTCCTCAGGGGACGACTC CGTGTTTGCCCACGACCTGCTGCCCCCGGCCCCACCCAGCAGTGGGGGCTCGCGGAC GTGAAGGGCCACTGGTCCCCAACAATGTGAGGGGTCCCTAGCAGCCCACCCTGCTGC TGGTGCACAGCCACTCCCCGGCATGAGACTCAGTGCAGATGGAGAGACAGCTACACA GAGCTTTGGTCTGTGTGTGTGTGTGCGTGTGTGTGTGTGTGCACATCCGCG TGTGCCTGTGTGCGTGCGCATCTTGCCTCCAGGTGCAGAGGTACCCTGGGTGTCCCC GCTGCTGTGCAACGGTCTCCTGACTGGTGCTGCAGCACCGAGGGGCCTTTGTTCTGG GGGGACCCAGTGCAGAATGTAAGTGGGCCCACCCGGTGGGACCCCCGTGGGGCAGGG AGCTGGGCCCGACATGGCTCCGGCCTCTGCCTTTGCACCCACGGGACATCACAGGGTG GGCCTCGGCCCCTCCCACACCCAAAGCTGAGCCTGCAGGGAAGCCCCACATGTCCAG CACCTTGTGCCTGGGGTGTTAGTGGCACCGCCTCCCCACCTCCAGGCTTTCCCACTT CCCACCCTGCCCCTCAGAGACTGAAATTACGGGTACCTGAAGATGGGAGCCTTTACC TTTTTATGCAAAAGGTTTATTCCGGAACTAGTGTACATTTCTATAAATAGATGCTGT GTATATGGTATATATACATATATATATAACATATATGGAAGAGGAAAAGGCTGGT ACAACGGAGGCCTGCGACCCTGGGGCACAGGAGGCAGGCATGGCCCTGGGCGGGGC GTGGGGGGCGTGGAGGGAGGCCCCAGGGGGTCTCACCCATGCAAGCAGAGGACCAG GGCCTTTTCTGGCACCGCAGTTTTGTTTTAAAACTGGACCTGTATATTTGTAAAGCT ATTTATGGGCCCCTGGCACTCTTGTTCCCACACCCCAACACTTCCAGCATTTAGCTG GCCACATGGCGGAGAGTTTTAATTTTTAACTTATTGACAACCGAGAAGGTTTATCCC GCCGATAGAGGGACGGCCAAGAATGTACGTCCAGCCTGCCCCGGAGCTGGAGGATCC CCTCCAAGCCTAAAAGGTTGTTAATAGTTGGAGGTGATTCCAGTGAAGATATTTTAT TTCCTTTGTCCTTTTTCAGGAGAATTAGATTTCTATAGGATTTTTCTTTAGGAGATT TATTTTTTGGACTTCAAAGCAAGCTGGTATTTTCATACAAATTCTTCTAATTGCTGT GTGTCCCAGGCAGGGAGACGGTTTCCAGGGAGGGGCCGGCCCTGTGTGCAGGTTCCG ATGTTATTAGATGTTACAAGTTTATATATATCTATATATATAAATTTATTGAGTTTTT ACAAGATGTATTTGTTGTAGACTTAACACTTCTTACGCAATGCTTCTAGAGTTTTAT |

TABLE 5-continued

FGFR sequences.

|  |  |  |
|---|---|---|
|  |  | AGCCTGGACTGCTACCTTTCAAAGCTTGGAGGGAAGCCGTGAATTCAGTTGGTTCGT<br>TCTGTACTGTTACTGGGCCCTGAGTCTGGGCAGCTGTCCCTTGCTTGCCTGCAGGGC<br>CATGGCTCAGGGTGGTCTCTTCTTGGGGCCCAGTGCATGGTGGCCAGAGGTGTCACC<br>CAAACCGGCAGGTGCGATTTTGTTAACCCAGCGACGAACTTTCCGAAAAATAAAGAC<br>ACCTGGTTGCTAACCTGG |
| SEQ ID<br>NO: 46 | FGFR3<br>isoform 3<br>Amino acid<br>sequence | MGAPACALALCVAVAIVAGASSESLGTEQRVVGRAAEVPGPEPGQQEQLVFGSGDAV<br>ELSCPPPGGGPMGPTVWVKDGTGLVPSERVLVGPQRLQVLNASHEDSGAYSCRQRLT<br>QRVLCHFSVRVTDAPSSGDDEDGEDEAEDTGVDTGAPYWTRPERMDKKLLAVPAANT<br>VRFRCPAAGNPTPSISWLKNGREFRGEHRIGGIKLRHQQWSLVMESVVPSDRGNYTC<br>VVENKFGSIRQTYTLDVLERSPHRPILQAGLPANQTAVLGSDVEFHCKVYSDAQPHI<br>QWLKHVEVNGSKVGPDGTPYVTVLKVSLESNASMSSNTPLVRIARLSSGEGPTLANV<br>SELELPADPKWELSRARLTLGKPLGEGCFGQVVMAEAIGIDKDRAAKPVTVAVKMLK<br>DDATDKDLSDLVSEMEMMKMIGKHKNIINLLGACTQGGPLYVLVEYAAKGNLREFLR<br>ARRPPGLDYSFDTCKPPEEQLTFKDLVSCAYQVARGMEYLASQKCIHRDLAARNVLV<br>TEDNVMKIADFGLARDVHNLDYYKKTTNGRLPVKWMAPEALFDRVYTHQSDVWSFGV<br>LLWEIFTLGGSPYPGIPVEELFKLLKEGHRMDKPANCTHDLYMIMRECWHAAPSQRP<br>TFKQLVEDLDRVLTVTSTDEYLDLSAPFEQYSPGGQDTPSSSSSGDDSVFAHDLLPP<br>APPSSGGSRT |
| SEQ ID<br>NO: 47 | FGFR3<br>isoform 4<br>Nucleic acid<br>sequence | CGCGCGCTGCCTGAGGACGCCGCGGCCCCCGCCCCCGCCATGGGCGCCCCTGCCTGC<br>GCCCTCGCGCTCTGCGTGGCCGTGGCCATCGTGGCCGGCGCCTCCTCGGAGTCCTTG<br>GGGACGGAGCAGCGCGTCGTGGGCGGCGCAGAAGTCCCGGGCCCAGAGCCCGGC<br>CAGCAGGAGCAGTTGGTCTTCGGCAGCGGGGATGCTGTGGAGCTGAGCTGTCCCCCG<br>CCCGGGGGTGGTCCCATGGGGCCCACTGTCTGGGTCAAGGATGGCACAGGGCTGGTG<br>CCCTCGGAGCGTGTCCTGGTGGGGCCCCAGCGGCTGCAGGTGCTGAATGCCTCCCAC<br>GAGGACTCCGGGGCCTACAGCTGCCGGCAGCGGCTCACGCAGCGCGTACTGTGCCAC<br>TTCAGTGTGCGGGTGACAGACGCTCCATCCTCGGGAGATGACGAAGACGGGGAGGAC<br>GAGGCTGAGGACACAGGTGTGGACACAGGGGCCCCTTACTGGACACGGCCCGAGCGG<br>ATGGACAAGAAGCTGCTGGCCGTGCCGGCCGCCAACACCGTCCGCTTCCGCTGCCCA<br>GCCGCTGGCAACCCCACTCCCTCCATCTCCTGGCTGAAGAACGGCAGGGAGTTCCGC<br>GGCGAGCACCGCATTGGAGGCATCAAGCTGCGGCATCAGCAGTGGAGCCTGGTCATG<br>GAAAGCGTGGTGCCCTCGGACCGCGGCAACTACACCTGCGTCGTGGAGAACAAGTTT<br>GGCAGCATCCGGCAGACGTACACGCTGGACGTGCTGGAGCGCTCCCCGCACCGGCCC<br>ATCCTGCAGGCGGGGCTGCCGGCCAACCAGACGGCGGTGCTGGGCAGCGACGTGGAG<br>TTCCACTGCAAGGTGTACAGTGACGCACAGCCCCACATCCAGTGGCTCAAGCACGTG<br>GAGGTGAATGGCAGCAAGGTGGGCCCGGACGGCACACCCTACGTTACCGTGCTCAAG<br>GTGTCCCTGGAGTCCAACGCGTCCATGAGCTCCAACACACCACTGGTGCGCATCGCA<br>AGGCTGTCCTCAGGGGAGGGCCCCACGCTGGCCAATGTCTCCGAGCTCGAGCTGCCT<br>GCCGACCCCAAATGGGAGCTGTCTCGGGCGCGGCTGACCCTGGGCAAGCCCCTTGGG<br>GAGGGCTGCTTCGGCCAGGTGGTCATGGCGGAGGCCATCGGCATTGACAAGGACCGG<br>GCCGCCAAGCCTGTCACCGTAGCCGTGAAGATGCTGAAAGACGATGCCACTGACAAG<br>GACCTGTCGGACCTGGTGTCTGAGATGGAGATGATGAAGATGATCGGGAAACACAAA<br>AACATCATCAACCTGCTGGGCGCCTGCACGCAGGGCGGGCCCCTGTACGTGCTGGTG<br>GAGTACGCGGCCAAGGGTAACCTGCGGGAGTTTCTGCGGGCGCGGCGGCCCCGGGC<br>CTGGACTACTCCTTCGACACCTGCAAGCCGCCCGAGGAGCAGCTCACCTTCAAGGAC<br>CTGGTGTCCTGTGCCTACCAGGTGGCCCGGGGCATGGAGTACTTGGCCTCCCAGAAG<br>TGCATCCACAGGGACCTGGCTGCCCGCAATGTGCTGGTGACCGAGGACAACGTGATG<br>AAGATCGCAGACTTCGGGCTGGCCCGGGACGTGCACAACCTCGACTACTACAAGAAG<br>ACGACCAACGGCCGGCTGCCCGTGAAGTGGATGGCGCCTGAGGCCTTGTTTGACCGA<br>GTCTACACTCACCAGAGTGACGTCTGGTCCTTTGGGGTCCTGCTCTGGGAGATCTTC<br>ACGCTGGGGGGCTCCCCGTACCCCGGCATCCCTGTGGAGGAGCTCTTCAAGCTGCTG<br>AAGGAGGGCCACCGCATGGACAAGCCCGCCAACTGCACACACGACCTGTACATGATC<br>ATGCGGGAGTGCTGGCATGCCGCGCCTCCCAGAGGCCCACCTTCAAGCAGCTGGTG<br>GAGGACCTGGACCGTGTCCTTACCGTGACGTCCACCGACGAGTACCTGGACCTGTCG<br>GCGCCTTTCGAGCAGTACTCCCCGGGTGGCCAGGACACCCCCAGCTCCAGCTCCTCA<br>GGGGACGACTCCGTGTTTGCCCACGACCTGCTGCCCCCGGCCCCACCCAGCAGTGGG<br>GGCTCGCGGACGTGAAGGGCCACTGGTCCCAACAATGTGAGGGGTCCCTAGCAGCC<br>CACCCTGCTGCTGGTGCA |
| SEQ ID<br>NO: 48 | FGFR3<br>isoform 4<br>Amino acid<br>sequence | MGAPACALALCVAVAIVAGASSESLGTEQRVVGRAAEVPGPEPGQQEQLVFGSGDAV<br>ELSCPPPGGGPMGPTVWVKDGTGLVPSERVLVGPQRLQVLNASHEDSGAYSCRQRLT<br>QRVLCHFSVRVTDAPSSGDDEDGEDEAEDTGVDTGAPYWTRPERMDKKLLAVPAANT<br>VRFRCPAAGNPTPSISWLKNGREFRGEHRIGGIKLRHQQWSLVMESVVPSDRGNYTC<br>VVENKFGSIRQTYTLDVLERSPHRPILQAGLPANQTAVLGSDVEFHCKVYSDAQPHI<br>QWLKHVEVNGSKVGPDGTPYVTVLKVSLESNASMSSNTPLVRIARLSSGEGPTLANV<br>SELELPADPKWELSRARLTLGKPLGEGCFGQVVMAEAIGIDKDRAAKPVTVAVKMLK<br>DDATDKDLSDLVSEMEMMKMIGKHKNIINLLGACTQGGPLYVLVEYAAKGNLREFLR<br>ARRPPGLDYSFDTCKPPEEQLTFKDLVSCAYQVARGMEYLASQKCIHRDLAARNVLV<br>TEDNVMKIADFGLARDVHNLDYYKKTTNGRLPVKWMAPEALFDRVYTHQSDVWSFGV<br>LLWEIFTLGGSPYPGIPVEELFKLLKEGHRMDKPANCTHDLYMIMRECWHAAPSQRP<br>TFKQLVEDLDRVLTVTSTDEYLDLSAPFEQYSPGGQDTPSSSSSGDDSVFAHDLLPP<br>APPSSGGSRT |
| SEQ ID<br>NO: 49 | FGFRA<br>isoform 1<br>Nucleic acid<br>sequence | CGCTCGCGGCCACGCCGCCGTCGCGGGTACATTCCTCGCTCCCGGCCGAGGAGCGCT<br>CGGGCTGTCTGCGGACCCTGCCGCGTGCAGGGGTCGCGGCCGGCTGGAGCTGGGAGT<br>GAGGCGGCGGAGGAGCCAGGTGAGGAGGAGCCAGGTGAGCAGGACCCTGTGCTGGGC<br>GCGGAGTCACGCAGGCTCGAGGAAGGCAGTTGGTGGGAAGTCCAGCTTGGGTCCCTG |

TABLE 5-continued

FGFR sequences.

|  |  |  |
|---|---|---|
|  |  | AGAGCTGTGAGAAGGAGATGCGGCTGCTGCTGGCCCTGTTGGGGGTCCTGCTGAGTG<br>TGCCTGGGCCTCCAGTCTTGTCCCTGGAGGCCTCTGAGGAAGTGGAGCTTGAGCCCT<br>GCCTGGCTCCCAGCCTGGAGCAGCAAGAGCAGGAGCTGACAGTAGCCCTTGGGCAGC<br>CTGTGCGTCTGTGCTGTGGGCGGGCTGAGCGTGGTGGCCACTGGTACAAGGAGGGCA<br>GTCGCCTGGCACCTGCTGGCCGTGTACGGGGCTGGAGGGGCCGCCTAGAGATTGCCA<br>GCTTCCTACCTGAGGATGCTGGCCGCTACCTCTGCCTGGCACGAGGCTCCATGATCG<br>TCCTGCAGAATCTCACCTTGATTACAGGTGACTCCTTGACCTCCAGCAACGATGATG<br>AGGACCCCAAGTCCCATAGGGACCCCTCGAATAGGCACAGTTACCCCCAGCAAGCAC<br>CCTACTGGACACACCCCAGCGCATGGAGAAGAAACTGCATGCAGTACCTGCGGGGA<br>ACACCGTCAAGTTCCGCTGTCCAGCTGCAGGCAACCCCACGCCCACCATCCGCTGGC<br>TTAAGGATGGACAGGCCTTTCATGGGGAGAACCGCATTGGAGGCATTCGGCTGCGCC<br>ATCAGCACTGGAGTCTCGTGATGGAGAGCGTGGTGCCCTCGGACCGCGGCACATACA<br>CCTGCCTGGTAGAGAACGCTGTGGGCAGCATCCGCTATAACTACCTGCTAGATGTGC<br>TGGAGCGGTCCCCGCACCGGCCCATCCTGCAGGCCGGGCTCCCGGCCAACACCACAG<br>CCGTGGTGGGCAGCGACGTGGAGCTGCTGTGCAAGGTGTACAGCGATGCCCAGCCCC<br>ACATCCAGTGGCTGAAGCACATCGTCATCAACGGCAGCAGCTTCGGAGCCGACGGTT<br>TCCCCTATGTGCAAGTCCTAAAGACTGCAGACATCAATAGCTCAGAGGTGGAGGTCC<br>TGTACCTGCGGAACGTGTCAGCCGAGGACGCAGGCGAGTACACCTGCCTCGCAGGCA<br>ATTCCATCGGCCTCTCCTACCAGTCTGCCTGGCTCACGGTGCTGCCAGAGGAGGACC<br>CCACATGGACCGCAGCAGCGCCCGAGGCCAGGTATACGGACATCATCCTGTACGCGT<br>CGGGCTCCCTGGCCTTGGCTGTGCTCCTGCTGCTGGCCGGGCTGTATCGAGGGCAGG<br>CGCTCCACGCCGGCACCCCCGCCCGCCCGCCACTGTGCAGAAGCTCTCCCGCTTCC<br>CTCTGGCCCGACAGTTCTCCCTGGAGTCAGGCTCTTCCGGCAAGTCAAGCTCATCCG<br>TGGTACGAGGCGTGCGTCTCTCCTCCAGCGGCCCCGCCTTGCTCGCCGGCCTCGTGA<br>GTCTAGATCTACCTCTCGACCCACTATGGGAGTTCCCCGGGACAGGCTGGTGCTTG<br>GGAAGCCCCTAGGCGAGGGCTGCTTTGGCCAGGTAGTACGTGCAGAGGCCTTTGGCA<br>TGGACCCTGCCCGGCCTGACCAAGCCAGCACTGTGGCCGTCAAGATGCTCAAAGACA<br>ACGCCTCTGACAAGGACCTGGCCGACCTGGTCTCGGAGATGGAGGTGATGAAGCTGA<br>TCGGCCGACACAAGAACATCATCAACCTGCTTGGTGTCTGCACCCAGGAAGGGCCCC<br>TGTACGTGATCGTGGAGTGCGCCGCCAAGGGAAACCTGCGGGAGTTCCTGCGGGCCC<br>GGCGCCCCCCAGGCCCCGACCTCAGCCCCGACGGTCCTCGGAGCAGTGAGGGGCCGC<br>TCTCCTTCCCAGTCCTGGTCTCCTGCGCCTACCAGGTGGCCCGAGGCATGCAGTATC<br>TGGAGTCCCGGAAGTGTATCCACCGGGACCTGGCTGCCCGCAATGTGCTGGTGACTG<br>AGGACAATGTGATGAAGATTGCTGACTTTGGGCTGGCCCGCGGCGTCCACCACATTG<br>ACTACTATAAGAAAACCAGCAACGGCCGCCTGCCTGTGAAGTGGATGGCCCCCGAGG<br>CCTTGTTTGACCGGGTGTACACACCAGAGTGACGTGTGGTCTTTTGGGATCCTGC<br>TATGGGAGATCTTCACCCTCGGGGGCTCCCCGTATCCTGGCATCCCGGTGGAGGAGC<br>TGTTCTCGCTGCTGCGGGAGGGACATCGGATGGACCGACCCCCACACTGCCCCCCAG<br>AGCTGTACGGGCTGATGCGTGAGTGCTGGCACGCAGCGCCCTCCCAGAGGCCTACCT<br>TCAAGCAGCTGGTGGAGGCGCTGGACAAGGTCCTGCTGGCCGTCTCTGAGGAGTACC<br>TCGACCTCCGCCTGACCTTCGGACCCTATTCCCCCTCTGGTGGGGACGCCAGCAGCA<br>CCTGCTCCTCCAGCGATTCTGTCTTCAGCCACGACCCCCTGCCATTGGGATCCAGCT<br>CCTTCCCCTTCGGGTCTGGGGTGCAGACATGAGCAAGGCTCAAGGCTGTGCAGGCAC<br>ATAGGCTGGTGGCCTTGGGCCTTGGGGCTCAGCACAGCCTGACACAGTGCTCGACC<br>TTGATAGCATGGGGCCCCTGGCCCAGAGTTGCTGTGCCGTGTCCAAGGGCCGTGCCC<br>TTGCCCTTGGAGCTGCCGTGCCTGTGTCCTGATGGCCCAAATGTCAGGGTTCTGCTC<br>GGCTTCTTGGACCTTGGCGCTTAGTCCCCATCCCGGGTTTGGCTGAGCCTGGCTGGA<br>GAGCTGCTATGCTAAACCTCCTGCCTCCCAATACCAGCAGGAGGTTCTGGGCCTCTG<br>AACCCCCTTTCCCCACACCTCCCCCTGCTGCTGCTGCCCCAGCGTCTTGACGGGAGC<br>ATTGGCCCCTGAGCCCAGAGAAGCTGGAAGCCTGCCGAAAACAGGAGCAAATGGCGT<br>TTTATAAATTATTTTTTTGAAATAAAGCTCTGTGTGCCTGGGTC |
| SEQ ID<br>NO: 50 | FGFRA<br>isoform 1<br>Amino acid<br>sequence | MRLLLALLGVLLSVPGPPVLSLEASEEVELEPCLAPSLEQQEQELTVALGQPVRLCC<br>GRAERGGHWYKEGSRLAPAGRVRGWRGRLEIASFLPEDAGRYLCLARGSMIVLQNLT<br>LITGDSLTSSNDDEDPKSHRDPSNRHSYPQQAPYWTHPQRMEKKLHAVPAGNTVKFR<br>CPAAGNPTPTIRWLKDGQAFHGENRIGGIRLRHQHWSLVMESVVPSDRGTYTCLVEN<br>AVGSIRYNYLLDVLERSPHRPILQAGLPANTTAVVGSDVELLCKVYSDAQPHIQWLK<br>HIVINGSSFGADGFPYVQVLKTADINSSEVEVLYLRNVSAEDAGEYTCLAGNSIGLS<br>YQSAWLTVLPEEDPTWTAAAPEARYTDIILYASGSLALAVLLLLAGLYRGQALHGRH<br>PRPPATVQKLSRFPLARQFSLESGSSGKSSSSLVRGVRLSSSGPALLAGLVSLDLPL<br>DPLWEFPRDRLVLGKPLGEGCFGQVVRAEAFGMDPARPDQASTVAVKMLKDNASDKD<br>LADLVSEMEVMKLIGRHKNIINLLGVCTQEGPLYVIVECAAKGNLREFLRARRPPGP<br>DLSPDGPRSSEGPLSFPVLVSCAYQVARGMQYLESRKCIHRDLAARNVLVTEDNVMK<br>IADFGLARGVHHIDYYKKTSNGRLPVKWMAPEALFDRVYTHQSDVWSFGILLWEIFT<br>LGGSPYPGIPVEELFSLLREGHRMDRPPHCPPELYGLMRECWHAAPSQRPTFKQLVE<br>ALDKVLLAVSEEYLDLRLTFGPYSPSGGDASSTCSSSDSVFSHDPLPLGSSSFPFGS<br>GVQT |
| SEQ ID<br>NO: 51 | FGFRA<br>isoform 2<br>Nucleic acid<br>sequence | GTCGCGGGTACATTCCTCGCTCCCGGCCGAGGAGCGCTCGGGCTGTCTGCGGACCCT<br>GCCGCGTGCAGGGGTCGCGGCCGGCTGGAGCTGGGAGTGAGGCGGCGGAGGAGCCAG<br>GTGAGGAGGAGCCAGGAAGGCAGTTGGTGGGAAGTCCAGCTTGGGTCCCTGAGAGCT<br>GTGAGAAGGAGATGCGGCTGCTGCTGGCCCTGTTGGGGGTCCTGCTGAGTGTGCCTG<br>GGCCTCCAGTCTTGTCCCTGGAGGCCTCTGAGGAAGTGGAGCTTGAGCCCTGCCTGG<br>CTCCCAGCCTGGAGCAGCAAGAGCAGGAGCTGACAGTAGCCCTTGGGCAGCCTGTGC<br>GTCTGTGCTGTGGGCGGGCTGAGCGTGGTGGCCACTGGTACAAGGAGGGCAGTCGCC<br>TGGCACCTGCTGGCCGTGTACGGGGCTGGAGGGGCCGCCTAGAGATTGCCAGCTTCC<br>TACCTGAGGATGCTGGCCGCTACCTCTGCCTGGCACGAGGCTCCATGATCGTCCTGC<br>AGAATCTCACCTTGATTACAGGTGACTCCTTGACCTCCAGCAACGATGATGAGGACC |

TABLE 5-continued

FGFR sequences.

|  |  |  |
|---|---|---|
|  |  | CCAAGTCCCATAGGGACCCCTCGAATAGGCACAGTTACCCCCAGCAAGCACCCTACT<br>GGACACACCCCCAGCGCATGGAGAAGAAACTGCATGCAGTACCTGCGGGGAACACCG<br>TCAAGTTCCGCTGTCCAGCTGCAGGCAACCCCACGCCCACCATCCGCTGGCTTAAGG<br>ATGGACAGGCCTTTCATGGGAGAACCGCATTGGAGGCATTCGGCTGCGCCATCAGC<br>ACTGGAGTCTCGTGATGGAGAGCGTGGTGCCCTCGGACCGCGGCACATACACCTGCC<br>TGGTAGAGAACGCTGTGGGCAGCATCCGCTATAACTACCTGCTAGATGTGCTGGAGC<br>GGTCCCCGCACCGGCCCATCCTGCAGGCCGGGCTCCCGGCCAACACCACAGCCGTGG<br>TGGGCAGCGACGTGGAGCTGCTGTGCAAGGTGTACAGCGATGCCCAGCCCCACATCC<br>AGTGGCTGAAGCACATCGTCATCAACGGCAGCAGCTTCGGAGCCGACGGTTTCCCCT<br>ATGTGCAAGTCCTAAAGACTGCAGACATCAATAGCTCAGAGGTGGAGGTCCTGTACC<br>TGCGGAACGTGTCAGCCGAGGACGCAGGCGAGTACACCTGCCTCGCAGGCAATTCCA<br>TCGGCCTCTCCTACCAGTCTGCCTGGCTCACGGTGCTGCCAGAGGAGGACCCCACAT<br>GGACCGCAGCAGCGCCCGAGGCCAGTTCTCCCTGGAGTCAGGCTCTTCCGGCAAGTC<br>AAGCTCATCCCTGGTACGAGGCGTGCGTCTCTCCTCCAGCGGCCCCGCCTTGCTCGC<br>CGGCCTCGCTGGTGCTTGGGAAGCCCCTAGGCGAGGGCTGCTTTGGCCAGGTAGTAC<br>GTGCAGAGGCCTTTGGCATGGACCCTGCCCGGCCTGACCAAGCCAGCACTGTGGCCG<br>TCAAGATGCTCAAAGACAACGCCCTGACAAGGACCTGGCCGACCTGGTCTCGGAGA<br>TGGAGGTGATGAAGCTGATCGGCCGACACAAGAACATCATCAACCTGCTTGGTGTCT<br>GCACCCAGGAAGGGCCCCTGTACGTGATCGTGGAGTGCGCCGCCAAGGGAAACCTGC<br>GGGAGTTCCTGCGGGCCCGGCGCCCCCAGGCCCCGACCTCAGCCCCGACGGTCCTC<br>GGAGCAGTGAGGGGCCGCTCTCCTTCCCAGTCCTGGTCTCCTGCGCCTACCAGGTGG<br>CCCGAGGCATGCAGTATCTGGAGTCCCGGAAGTGTATCCACCGGGACCTGGCTGCCC<br>GCAATGTGCTGGTGACTGAGGACAATGTGATGAAGATTGCTGACTTTGGGCTGGCCC<br>GCGGCGTCCACCACATTGACTACTATAAGAAAACCAGCAACGGCCGCCTGCCCTGTGA<br>AGTGGATGGCGCCCGAGGCCTTGTTTGACCGGGTGTACACACACCAGAGTGACGTGT<br>GGTCTTTTGGGATCCTGCTATGGGAGATCTTCACCCTCGGGGGCTCCCCGTATCCTG<br>GCATCCCGGTGGAGGAGCTGTTCTCGCTGCTGCGGGAGGGACATCGGATGGACCGAC<br>CCCCACACTGCCCCCCAGAGCTGTACGGGCTGATGCGTGAGTGCTGGCACGCAGCGC<br>CCTCCCAGAGGCCTACCTTCAAGCAGCTGGTGGAGGCGCTGGACAAGGTCCTGCTGG<br>CCGTCTCTGAGGAGTACCTCGACCTCCGCCTGACCTTCGGACCCTATTCCCCCTCTG<br>GTGGGGACGCCAGCAGCACCTGCTCCTCCAGCGATTCTGTCTTCAGCCACGACCCCC<br>TGCCATTGGGATCCAGCTCCTTCCCCTTCGGGTCTGGGGTGCAGACATGAGCAAGGC<br>TCAAGGCTGTGCAGGCACATAGGCTGGTGGCCTTGGGCCTTGGGGCTCAGCCACAGC<br>CTGACACAGTGCTCGACCTTGATAGCATGGGGCCCCTGGCCCAGAGTTGCTGTGCCG<br>TGTCCAAGGGCCGTGCCCTTGCCCTTGGAGCTGCCGTGCCTGTGTCCTGATGCCCA<br>AATGTCAGGGTTCTGCTCGGCTTCTTGGACCTTGGCGCTTAGTCCCCATCCCGGGTT<br>TGGCTGAGCCTGGCTGGAGAGCTGCTATGCTAAACCTCCTGCCTCCCAATACCAGCA<br>GGAGGTTCTGGGCCTCTGAACCCCCTTTCCCCACACCTCCCCCTGCTGCTGCTG |
| SEQ ID<br>NO: 52 | FGFR4<br>isoform 2<br>Amino acid<br>sequence | MRLLLALLGVLLSVPGPPVLSLEASEEVELEPCLAPSLEQQEQELTVALGQPVRLCC<br>GRAERGGHWYKEGSRLAPAGRVRGWRGRLEIASFLPEDAGRYLCLARGSMIVLQNLT<br>LITGDSLTSSNDDEDPKSHRDPSNRHSYPQQAPYWTHPQRMEKKLHAVPAGNTVKFR<br>CPAAGNPTPTIRWLKDGQAFHGENRIGGIRLRHQHWSLVMESVVPSDRGTYTCLVEN<br>AVGSIRYNYLLDVLERSPHRPILQAGLPANTTAVVGSDVELLCKVYSDAQPHIQWLK<br>HIVINGSSFGADGFPYVQVLKTADINSSEVEVLYLRNVSAEDAGEYTCLAGNSIGLS<br>YQSAWLTVLPEEDPTWTAAAPEASSPWSQALPASQAHPWYEACVSPPAAPPCSPASL<br>VLGKPLGEGCFGQVVRAEAFGMDPARPDQASTVAVKMLKDNASDKDLADLVSEMEVM<br>KLIGRHKNIINLLGVCTQEGPLYVIVECAAKGNLREFLRARRPPGPDLSPDGPRSSE<br>GPLSFPVLVSCAYQVARGMQYLESRKCIHRDLAARNVLVTEDNVMKIADFGLARGVH<br>HIDYYKKTSNGRLPVKWMAPEALFDRVYTHQSDVWSFGILLWEIFTLGGSPYPGIPV<br>EELFSLLREGHRMDRPPHCPPELYGLMRECWHAAPSQRPTFKQLVEALDKVLLAVSE<br>EYLDLRLTFGPYSPSGGDASSTCSSSDSVFSHDPLPLGSSSFPFGSGVQT |
| SEQ ID<br>NO: 53 | FGFR4<br>isoform 3<br>Nucleic acid<br>sequence | ACATTCCTCGCTCCCGGCCGAGGAGCGCTCGGGCTGTCTGCGGACCCTGCCGCGTGC<br>AGGGGTCGCGGCCGGCTGGAGCTGGGAGTGAGGCGGCGGAGGAGCCAGGTGAGGAGG<br>AGCCAGGAAGGCAGTTGGTGGGAAGTCCAGCTTGGGTCCCTGAGAGCTGTGAGAAGG<br>AGATGCGGCTGCTGCTGGCCCTGTTGGGGGTCCTGCTGAGTGTGCCTGGGCCTCCAG<br>TCTTGTCCCTGGAGGCCTCTGAGGAAGTGGAGCTTGAGCCCTGCCTGGCTCCCAGCC<br>TGGAGCAGCAAGAGCAGGAGCTGACAGTAGCCCTTGGGCAGCCTGTGCGTCTGTGCT<br>GTGGGCGGGCTGAGCGTGGTGGCCACTGGTACAAGGAGGGCAGTCGCCTGGCACCTG<br>CTGGCCGTGTACGGGCTGGAGGGGCCGCCTAGAGATTGCCAGCTTCCTACCTGAGG<br>ATGCTGGCCGCTACCTCTGCCTGGCACGAGGCTCCATGATCGTCCTGCAGAATCTCA<br>CCTTGATTACAGGTGACTCCTTGACCTCCAGCAACGATGATGAGGACCCCAAGTCCC<br>ATAGGGACCCCTCGAATAGGCACAGTTACCCCCAGCAAGCACCCTACTGGACACACC<br>CCCAGCGCATGGAGAAGAAACTGCATGCAGTACCTGCGGGGAACACCGTCAAGTTCC<br>GCTGTCCAGCTGCAGGCAACCCCACGCCCACCATCCGCTGGCTTAAGGATGGACAGG<br>CCTTTCATGGGAGAACCGCATTGGAGGCATTCGGCTGCGCCATCAGCACTGGAGTC<br>TCGTGATGGAGAGCGTGGTGCCCTCGGACCGCGGCACATACACCTGCCTGGTAGAGA<br>ACGCTGTGGGCAGCATCCGCTATAACTACCTGCTAGATGTGCTGGAGCGGTCCCCGC<br>ACCGGCCCATCCTGCAGGCCGGGCTCCCGGCCAACACCACAGCCGTGGTGGGCAGCG<br>ACGTGGAGCTGCTGTGCAAGGTGTACAGCGATGCCCAGCCCCACATCCAGTGGCTGA<br>AGCACATCGTCATCAACGGCAGCAGCTTCGGAGCCGACGGTTTCCCCTATGTGCAAG<br>TCCTAAAGACTGCAGACATCAATAGCTCAGAGGTGGAGGTCCTGTACCTGCGGAACG<br>TGTCAGCCGAGGACGCAGGCGAGTACACCTGCCTCGCAGGCAATTCCATCGGCCTCT<br>CCTACCAGTCTGCCTGGCTCACGGTGCTGCCAGAGGAGGACCCCACATGGACCGCAG<br>CAGCGCCCGAGGCCAGGTATACGGACATCATCCTGTACGCGTCGGGCTCCCTGGCCT<br>TGGCTGTGCTCCTGCTGCTGGCCGGGCTGTATCGAGGGCAGGCGCTCCACGGCCGGC<br>ACCCCGCCCGCCCGCCACTGTGCAGAAGCTCTCCCGCTTCCCTCTGGCCCGACAGT |

TABLE 5-continued

| | | FGFR sequences. |
|---|---|---|
| | | TCTCCCTGGAGTCAGGCTCTTCCGGCAAGTCAAGCTCATCCCTGGTACGAGGCGTGC
GTCTCTCCTCCAGCGGCCCCGCCTTGCTCGCCGGCCTCGTGAGTCTAGATCTACCTC
TCGACCCACTATGGGAGTTCCCCCGGGACAGGCTGGTGCTTGGGAAGCCCCTAGGCG
AGGGCTGCTTTGGCCAGGTAGTACGTGCAGAGGCCTTTGGCATGGACCCTGCCCGGC
CTGACCAAGCCAGCACTGTGGCCGTCAAGATGCTCAAAGACAACGCCTCTGACAAGG
ACCTGGCCGACCTGGTCTCGGAGATGGAGGTGATGAAGCTGATCGGCCGACACAAGA
ACATCATCAACCTGCTTGGTGTCTGCACCCAGGAAGGGCCCCTGTACGTGATCGTGG
AGTGCGCCGCCAAGGGAAACCTGCGGGAGTTCCTGCGGGCCCGGCGCCCCCAGGCC
CCGACCTCAGCCCCGACGGTCCTCGGAGCAGTGAGGGGCCGCTCTCCTTCCCAGTCC
TGGTCTCCTGCGCCTACCAGGTGGCCCGAGGCATGCAGTATCTGGAGTCCCGGAAGT
GTATCCACCGGGACCTGGCTGCCCGCAATGTGCTGGTGACTGAGGACAATGTGATGA
AGATTGCTGACTTTGGGCTGGCCCGCGGCGTCCACCACATTGACTACTATAAGAAAA
CCAGCAACGGCCGCCTGCCTGTGAAGTGGATGGCGCCCGAGGCCTTGTTTGACCGGG
TGTACACACACCAGAGTGACGTGTGGTCTTTTGGGATCCTGCTATGGGAGATCTTCA
CCCTCGGGGGCTCCCCGTATCCTGGCATCCCGGTGGAGGAGCTGTTCTCGCTGCTGC
GGGAGGGACATCGGATGGACCGACCCCCACACTGCCCCCCAGAGCTGTACGGGCTGA
TGCGTGAGTGCTGGCACGCAGCGCCCTCCCAGAGGCCTACCTTCAAGCAGCTGGTGG
AGGCGCTGGACAAGGTCCTGCTGGCCGTCTCTGAGGAGTACCTCGACCTCCGCCTGA
CCTTCGGACCCTATTCCCCCTCTGGTGGGGACGCCAGCAGCACCTGCTCCTCCAGCG
ATTCTGTCTTCAGCCACGACCCCCCTGCCATTGGGATCCAGCTCCTTCCCCTTCGGGT
CTGGGGTGCAGACATGAGCAAGGCTCAAGGCTGTGCAGGCACATAGGCTGGTGGCCT
TGGGCCTTGGGGCTCA |
| SEQ ID NO: 54 | FGFR4 isoform 3 Amino acid sequence | MRLLLALLGVLLSVPGPPVLSLEASEEVELEPCLAPSLEQQEQELTVALGQPVRLCC
GRAERGGHWYKEGSRLAPAGRVRGWRGRLEIASFLPEDAGRYLCLARGSMIVLQNLT
LITGDSLTSSNDDEDPKSHRDPSNRHSYPQQAPYWTHPQRMEKKLHAVPAGNTVKFR
CPAAGNPTPTIRWLKDGQAFHGENRIGGIRLRHQHWSLVMESVVPSDRGTYTCLVEN
AVGSIRYNYLLDVLERSPHRPILQAGLPANTTAVVGSDVELLCKVYSDAQPHIQWLK
HIVINGSSFGADGFPYVQVLKTADINSSEVEVLYLRNVSAEDAGEYTCLAGNSIGLS
YQSAWLTVLPEEDPTWTAAAPEARYTDIILYASGSLALAVLLLLAGLYRGQALHGRH
PRPPATVQKLSRFPLARQFSLESGSSGKSSSSLVRGVRLSSSGPALLAGLVSLDLPL
DPLWEFPRDRLVLGKPLGEGCFGQVVRAEAFGMDPARPDQASTVAVKMLKDNASDKD
LADLVSEMEVMKLIGRHKNIINLLGVCTQEGPLYVIVECAAKGNLREFLRARRPPGP
DLSPDGPRSSEGPLSFPVLVSCAYQVARGMQYLESRKCIHRDLAARNVLVTEDNVMK
IADFGLARGVHHIDYYKKTSNGRLPVKWMAPEALFDRVYTHQSDVWSFGILLWEIFT
LGGSPYPGIPVEELFSLLREGHRMDRPPHCPPELYGLMRECWHAAPSQRPTFKQLVE
ALDKVLLAVSEEYLDLRLTFGPYSPSGGDASSTCSSSDSVFSHDPLPLGSSSFPFGS
GVQT |
| SEQ ID NO: 55 | FGFR4 isoform 4 Nucleic acid sequence | AGTCCAGCTTGGGTCCCTGAGAGCTGTGAGAAGGAGATGCGGCTGCTGCTGGCCCTG
TTGGGGGTCCTGCTGAGTGTGCCTGGGCCTCCAGTCTTGTCCCTGGAGGCCTCTGAG
GAAGTGGAGCTTGAGCCCTGCCTGGCTCCCAGCCTGGAGCAGCAAGAGCAGGAGCTG
ACAGTAGCCCTTGGGCAGCCTGTGCGTCTGTGCTGTGGGCGGGCTGAGCGTGGTGGC
CACTGGTACAAGGAGGGCAGTCGCCTGGCACCTGCTGGCCGTGTACGGGGCTGGAGG
GGCCGCCTAGAGATTGCCAGCTTCCTACCTGAGGATGCTGGCCGCTACCTCTGCCTG
GCACGAGGCTCCATGATCGTCCTGCAGAATCTCACCTTGATTACAGGTGACTCCTTG
ACCTCCAGCAACGATGATGAGGACCCCAAGTCCCATAGGGACCCCTCGAATAGGCAC
AGTTACCCCCAGCAAGCACCCTACTGGACACACCCCCAGCGCATGGAGAAGAAACTG
CATGCAGTACCTGCGGGGAACACCGTCAAGTTCCGCTGTCCAGCTGCAGGCAACCCC
ACGCCCACCATCCGTTGGCTTAAGGATGGACAGGCCTTTCATGGGGAGAACCGCATT
GGAGGCATTCGGCTGCGCCATCAGCACTGGAGTCTCGTGATGGAGAGCGTGGTGCCC
TCGGACCGCGGCACATACACCTGCCTGGTAGAGAACGCTGTGGGCAGCATCCGCTAT
AACTACCTGCTAGATGTGCTGGAGCGGTCCCCGCACCGGCCCATCCTGCAGGCCGGG
CTCCCGGCCAACACCACAGCCGTGGTGGGCAGCGACGTGGAGCTGCTGTGCAAGGTG
TACAGCGATGCCCAGCCCCACATCCAGTGGCTGAAGCACATCGTCATCAACGGCAGC
AGCTTCGGAGCCGACGGTTTCCCCTATGTGCAAGTCCTAAAGACTGCAGACATCAAT
AGCTCAGAGGTGGAGGTCCTGTACCTGCGGAACGTGTCAGCCGAGGACGCAGGCGAG
TACACCTGCCTCGCAGGCAATTCCATCGGCCTCTCCTACCAGTCTGCCTGGCTCACG
GTGCTGCCAGGTACTGGGCGCATCCCCACCTCACATGTGACAGCCTGACTCCAGCA
GGCAGAACCAAGTCTCCCACTTTGCAGTTCTCCCTGGAGTCAGGCTCTTCCGGCAAG
TCAAGCTCATCCCTGGTACGAGGCGTGCGTCTCTCCTCCAGCGGCCCCGCCTTGCTC
GCCGGCCTCGTGAGTCTAGATCTACCTCTCGACCCACTATGGGAGTTCCCCCGGGAC
AGGCTGGTGCTTGGGAAGCCCCTAGGCGAGGGCTGCTTTGGCCAGGTAGTACGTGCA
GAGGCCTTTGGCATGGACCCTGCCCGGCCTGACCAAGCCAGCACTGTGGCCGTCAAG
ATGCTCAAAGACAACGCCTCTGACAAGGACCTGGCCGACCTGGTCTCGGAGATGGAG
GTGATGAAGCTGATCGGCCGACACAAGAACATCATCAACCTGCTTGGTGTCTGCACC
CAGGAAGGGCCCCTGTACGTGATCGTGGAGTGCGCCGCCAAGGGAAACCTGCGGGAG
TTCCTGCGGGCCCGGCGCCCCCAGGCCCCGACCTCAGCCCCGACGGTCCTCGGAGC
AGTGAGGGGCCGCTCTCCTTCCCAGTCCTGGTCTCCTGCGCCTACCAGGTGGCCCGA
GGCATGCAGTATCTGGAGTCCCGGAAGTGTATCCACCGGGACCTGGCTGCCCGCAAT
GTGCTGGTGACTGAGGACAATGTGATGAAGATTGCTGACTTTGGGCTGGCCCGCGGC |

TABLE 5-continued

FGFR sequences.

|  |  |  |
|---|---|---|
|  |  | GTCCACCACATTGACTACTATAAGAAAACCAGCAACGGCCGCCTGCCTGTGAAGTGG<br>ATGGCGCCCGAGGCCTTGTTTGACCGGGTGTACACACACCAGAGTGACGTGTGGTCT<br>TTTGGGATCCTGCTATGGGAGATCTTCACCCTCGGGGGCTCCCCGTATCCTGGCATC<br>CCGGTGGAGGAGCTGTTCTCGCTGCTGCGGGAGGGACATCGGATGGACCGACCCCCA<br>CACTGCCCCCCAGAGCTGTACGGGCTGATGCGTGAGTGCTGGCACGCAGCGCCCTCC<br>CAGAGGCCTACCTTCAAGCAGCTGGTGGAGGCGCTGGACAAGGTCCTGCTGGCCGTC<br>TCTGAGGAGTACCTCGACCTCCGCCTGACCTTCGGACCCTATTCCCCCTCTGGTGGG<br>GACGCCAGCAGCACCTGCTCCTCCAGCGATTCTGTCTTCAGCCACGACCCCCTGCCA<br>TTGGGATCCAGCTCCTTCCCCTTCGGGTCTGGGGTGCAGACATGAGCAAGGCTCAAG<br>GCTGTGCAGGCACATAGGCTGGTGGCCTTGGGCCTTGGGGCTCAGCCACAGCCTGAC<br>ACAGTGCTCGACCTTGATAGCATG |
| SEQ ID<br>NO: 56 | FGFRA<br>isoform 4<br>Amino acid<br>sequence | MRLLLALLGVLLSVPGPPVLSLEASEEVELEPCLAPSLEQQEQELTVALGQPVRLCC<br>GRAERGGHWYKEGSRLAPAGRVRGWRGRLEIASFLPEDAGRYLCLARGSMIVLQNLT<br>LITGDSLTSSNDDEDPKSHRDPSNRHSYPQQAPYWTHPQRMEKKLHAVPAGNTVKFR<br>CPAAGNPTPTIRWLKDGQAFHGENRIGGIRLRHQHWSLVMESVVPSDRGTYTCLVEN<br>AVGSIRYNYLLDVLERSPHRPILQAGLPANTTAVVGSDVELLCKVYSDAQPHIQWLK<br>HIVINGSSFGADGFPYVQVLKTADINSSEVEVLYLRNVSAEDAGEYTCLAGNSIGLS<br>YQSAWLTVLPGTGRIPHLTCDSLTPAGRTKSPTLQFSLESGSSGKSSSSLVRGVRLS<br>SSGPALLAGLVSLDLPLDPLWEFPRDRLVLGKPLGEGCFGQVVRAEAFGMDPARPDQ<br>ASTVAVKMLKDNASDKDLADLVSEMEVMKLIGRHKNIINLLGVCTQEGPLYVIVECA<br>AKGNLREFLRARRPPGPDLSPDGPRSSEGPLSFPVLVSCAYQVARGMQYLESRKCIH<br>RDLAARNVLVTEDNVMKIADFGLARGVHHIDYYKKTSNGRLPVKWMAPEALFDRVYT<br>HQSDVWSFGILLWEIFTLGGSPYPGIPVEELFSLLREGHRMDRPPHCPPELYGLMRE<br>CWHAAPSQRPTFKQLVEALDKVLLAVSEEYLDLRLTFGPYSPSGGDASSTCSSSDSV<br>FSHDPLPLGSSSFPFGSGVQT |
| SEQ ID<br>NO: 57 | FGFR1<br>Subdomain V<br>Amino acid<br>sequence | IVEYASKGNLR |
| SEQ ID<br>NO: 58 | FGFR2<br>Subdomain V<br>Amino acid<br>sequence | IVEYASKGNLR |
| SEQ ID<br>NO: 59 | FGFR3<br>Subdomain V<br>Amino acid<br>sequence | LVEYAAKGNLR |
| SEQ ID<br>NO: 60 | FGFR4<br>Subdomain V<br>Amino acid<br>sequence | IVECAAKGNLR |

Bold: FGFR subdomain V
Underlined: Cysteine in FGFR4 subdomain V

Although the invention has been described with reference to the above examples, it will be understood that modifications and variations are encompassed within the spirit and scope of the invention. Accordingly, the invention is limited only by the following claims.

SEQUENCE LISTING (60 sequences)

SEQ ID NO: 1 - protein, 5900 aa, Homo sapiens
AGATGCAGGGGCGCAAACGCCAAAGGAGACCAGGCTGTAGGAAGAGAAGGGCAGAGCGCCGGACAGCTCGGCCCGCTCCCCGTCCTTTGGGGCCGCGGCTGGGGAACTACAAGGCCCAGCAGGCAGCTGCAGGGGGCGGAGGCGGAGGAGGGACCAGCGCGGGTGGGAGTGAGAGAGCGAGCCCTCGCGCCCCGCCGGCGCATAGCGCTCGGAGCGCTCTTGCGGCCACAGGCGCGGCGTCCTCGGCGGCGGGCGGCAGCTAGCGGGAGCCGGGACGCCGGTGCAGCCGCAGCGCGCGGAGGAACCCGGGTGTGCCGGGAGCTGGGCGGCCACGTCCGGACGGGACCGAGACCCCTCGTAGCGCATTGCGGCGACCTCGCCTTCCCCGGCCGCGAGCGCGCCGCTGCTTGAAAAGCCGCGGAACCCAAGGACTTTTCTCCGGTCCGAGCTCGGGGCGCCCCGCAGGGCGCACGGTACCCGTGCTGCAGTCGGGCACGCCGCGGCGCCGGGGCCTCCGCAGGGCGATGGAGCCCGGTCTGCAAGGAAAGTGAGGCGCCGCCGCTGCGTTCTGGAGGAGGGGGGCACAAGGTCTGGAGACCCCGGGTGGCGGACGGGAGCCCTCCCCCCGCCCCGCCTCCGGGGCACCAGCTCCGGCTCCATTGTTCCCGCCCGGGCTGGAGGCGCCGAGCACCGAGCGCCGCCGGGAGTCGAGCGCCGGCCGCGGAGCTCTTGCGACCCCGCCAGGACCCGAACAGAGCCCGGGGGCGGCGGGCCGGAGCCGGGGACGCGGGCACACGCCCGCTCGCACAAGCCACGGCGGACTCTCCCGAGGCGGAACCTCCACGCCGAGCGAGGGTCAGTTTGAAAAGGAGGATCGAGCTCACTGTGGAGTATCCATGGAGATGTGGAGCCTTGTCACCAACCTCTAACTGCAGAACTGGGATGTGGAGCTGGAAGTGCCTCCTCTTCTGGGCTGTGCTGGTCACAGCCACACTCTGCACCGCTAGGCCGTCCCCGACCTTGCCTGAACAAGCCCAGCCCTGGGGAGCCCCTGTGGAAGTGGAGTCCTTCCTGGTCCACCCCGGTGACCTGCTGCAGCTTCGCTGTCGGCTGCGGGACGATGTGCAGAGCATCAACTGGCTGCGGGACGGGGTGCAGCTGGCGGAAAGCAACCGCACCCGCATCACAGGGGAGGAGGTGGAGGTGCAGGACTCCGTGCCCGCAGACTCCGGCCTCTATGCTTGCGTAACCAGCAGCCCCTCGGGCAGTGACACCACCTACTTCTCCGTCAATGTTTCAGATGCTCTCCCCTCCTCGGAGGATGATGATGATGATGATGACTCCTCTTCAGAGGAGAAAGAAACAGATAACACCAAACCAAACCGTATGCCCGTAGCTCCATATTGGACATCCCCAGAAAAGATGGAAAAGAAATTGCATGCAGTGCCGGCTGCCAAGACAGTGAAGTTCAAATGCCCTTCCAGTGGGACCCCAAACCCCACACTGCGCTGGTTGAAAAATGGCAAAGAATTCAAACCTGACCACAGAATTGGAGGCTACAAGGTCCGTTATGCCACCTGGAGCATCATAATGGACTCTGTGGTGCCCTCTGACAAGGGCAACTACACCTGCATTGTGGAGAATGAGTACGGCAGCATCAACCACACATACCAGCTGGATGTCGTGGAGCGGTCCCCTCACCGGCCCATCCTGCAAGCAGGGTTGCCCGCCAACAAAACAGTGGCCCTGGGTAGCAACGTGGAGTTCATGTGTAAGGTGTACAGTGACCCGCAGCCGCACATCCAGTGGCTAAAGCACATCGAGGTGAATGGGAGCAAGATTGGCCCAGACAACCTGCCTTATGTCCAGATCTTGAAGACTGCTGGAGTTAATACCACCGACAAAGAGATGGAGGTGCTTCACTTAAGAAATGTCTCCTTTGAGGACGCAGGGGAGTATACGTGCTTGGCGGGTAACTCTATCGGACTCTCCCATCACTCTGCATGGTTGACCGTTCTGGAAGCCCTGGAAGAGAGGCCGGCAGTGATGACCTCGCCCCTGTACCTGGAGATCATCATCTATTGCACAGGGGCCTTCCTCATCTCCTGCATGGTGGGGTCGGTCATCGTCTACAAGATGAAGAGTGGTACCAAGAAGAGTGACTTCCACAGCCAGATGGCTGTGCACAAGCTGGCCAAGAGCATCCCTCTGCGCAGACAGGTAACAGTGTCTGCTGACTCCAGTGCATCCATGAACTCTGGGGTTCTTCTGGTTCGGCCATCACGGCTCTCCTCCAGTGGGACTCCCATGCTAGCAGGGGTCTCTGAGTATGAGCTTCCCGAAGACCCTCGCTGGGAGCTGCCTCGGGACAGACTGGTCTTAGGCAAACCCCTGGGAGAGGGCTGCTTTGGGCAGGTGGTGTTGGCAGAGGCTATCGGGCTGGACAAGGACAAACCCAACCGTGTGACCAAAGTGGCTGTGAAGATGTTGAAGTCGGACGCAACAGAGAAAGACTTGTCAGACCTGATCTCAGAAATGGAGATGATGAAGATGATCGGGAAGCATAAGAATATCATCAACCTGCTGGGGGCCTGCACGCAGGATGGTCCCTTGTATGTCATCGTGGAGTATGCCTCCAAGGGCAACCTGCGGGAGTACCTGCAGGCCCGGAGGCCCCCAGGGCTGGAATACTGCTACAACCCCAGCCACAACCCAGAGGAGCAGCTCTCCTCCAAGGACCTGGTGTCCTGCGCCTACCAGGTGGCCCGAGGCATGGAGTATCTGGCCTCCAAGAAGTGCATACACCGAGACCTGGCAGCCAGGAATGTCCTGGTGACAGAGGACAATGTGATGAAGATAGCAGACTTTGGCCTCGCACGGGACATTCACCACATCGACTACTATAAAAAGACAACCAACGGCCGACTGCCTGTGAAGTGGATGGCACCCGAGGCATTATTTGACCGGATCTACACCCACCAGAGTGATGTGTGGTCTTTCGGGGTGCTCCTGTGGGAGATCTTCACTCTGGGCGGCTCCCCATACCCCGGTGTGCCTGTGGAGGAACTTTTCAAGCTGCTGAAGGAGGGTCACCGCATGGACAAGCCCAGTAACTGCACCAACGAGCTGTACATGATGATGCGGGACTGCTGGCATGCAGTGCCCTCACAGAGACCCACCTTCAAGCAGCTGGTGGAAGACCTGGACCGCATCGTGGCCTTGACCTCCAACCAGGAGTACCTGGACCTGTCCATGCCCCTGGACCAGTACTCCCCCAGCTTTCCCGACACCCGGAGCTCTACGTGCTCCTCAGGGGAGGATTCCGTCTTCTCTCATGAGCCGCTGCCCGAGGAGCCCTGCCTGCCCCGACACCCAGCCCAGCTTGCCAATGGCGGACTCAAACGCCGCTGACTGCCACCCACACGCCCTCCCCAGACTCCACCGTCAGCTGTAACCCTCACCCACAGCCCCTGCTGGGCCCACCACCTGTCCGTCCCTGTCCCCTTTCCTGCTGGCAGGAGCCGGCTGCCTACCAGGGGCCTTCCTGTGTGGCCTGCCTTCACCCCACTCAGCTCACCTCTCCCTCCACCTCCTCTCCACCTGCTGGTGAGAGGTGCAAAGAGGCAGATCTTTGCTGCCAGCCACTTCATCCCCTCCCAGATGTTGGACCAACACCCCTCCCTGCCACCAGGCACTGCCTGGAGGGCAGGGAGTGGGAGCCAATGAACAGGCATGCAAGTGAGAGCTTCCTGAGCTTTCTCCTGTCGGTTTGGTCTGTTTTGCCTTCACCCATAAGCCCCTCGCACTCTGGTGGCAGGTGCCTTGTCCTCAGGGCTACAGCAGTAGGGAGGTCAGTGCTTCGTGCCTCGATTGAAGGTGACCTCTGCCCCAGATAGGTGGTGCCAGTGGCTTATTAATTCCGATACTAGTTTGCTTTGCTGACCAAATGCCTGGTACCAGAGGATGGTGAGGCGAAGGCCAGGTTGGGGGCAGTGTTGTGGCCCTGGGGCCCAGCCCCAAACTGGGGGCTCTGTATATAGCTATGAAGAAAACACAAAGTGTATAAATCTGAGTATATATTTACATGTCTTTTTAAAAGGGTCGTTACCAGAGATTTACCCATCGGGTAAGATGCTCCTGGTGGCTGGGAGGCATCAGTTGCTATATATTAAAAACAAAAAAGAAAAAAAAGGAAAATGTTTTTAAAAAGGTCATATATTTTTTGCTACTTTTGCTGTTTTATTTTTTTAAATTATGTTCTAAACCTATTTTCAGTTTAGGTCCCTCAATAAAAATTGCTGCTGCTTCATTTATCTATGGGCTGTATGAAAAGGGTGGGAATGTCCACTGGAAAGAAGGGACACCCACGGGCCCTGGGGCTAGGTCTGTCCCGAGGGCACCGCATGCTCCCGGCGCAGGTTCCTTGTAACCTCTTCTTCCTAGGTCCTGCACCCAGACCTCACGACGCACCTCCTGCCTCTCCGCTGCTTTTGGAAAGTCAGAAAAAGAAGATGTCTGCTTCGAGGGCAGGAACCCCATCCATGCAGTAGAGGCGCTGGGCAGAGAGTCAAGGCCCAGCAGCCATCGACCATGGATGGTTTCCTCCAAGGAAACCGGTGGGGTTGGGCTGGGGAGGGGGCACCTACCTAGGAATAGCCACGGGGTAGAGCTACAGTGATTAAGAGGAAAGCAAGGGCGCGGTTGCTCACGCCTGTAATCCCAGCACTTTGGGACACCGAGGTGGGCAGATCACTTCAGGTCAGGAGTTTGAGACCAGCCTGGCCAACTTAGTGAAACCCCATCTCTACTAAAAATGCAAAAATTATCCAGGCATGGTGGCACACGCCTGTAATCCCAGCTCCACAGGAGGCTGAGGCAGAATCCCTTGAAGCTGGGAGGCGGAGGTTGCAGTGAGCCGAGATTGCGCCATTGCACTCCAGCCTGGGCAACAGAGAAAACAAAAAGGAAAACAAATGATGAAGGTCTGCAGAAACTGAAACCCAGACATGTGTCTGCCCCCTCTATGTGGGCATGGTTTTGCCAGTGCTTCTAAGTGCAGGAGAACATGTCACCTGAGGCTAGTTTTGCATTCAGGTCCCTGGCTTCGTTTCTTGTTGGTATGCCTCCCCAGATCGTCCTTCCTGTATCCATGTGACCAGACTGTATTTGTTGGGACTGTCGCAGATCTTGGCTTCTTACAGTTCTTCCTGTCCAAACTCCATCCTGTCCCTCAGGAACGGGGGGAAAATTCTCCGAATGTTTTTGGTTTTTTGGCTGCTTGGAATTTACTTCTGCCACCTGCTGGTCATCACTGTCCTCACTAAGTGGATTCTGGCTCCCCCGTACCTCATGGCTCAAACTACCACTCCTCAGTCGCTATATTAAAGCTTATATTTTGCTGGATTACTGCTAAATACAAAAGAAAGTTCAATATGTTTTCATTTCTGTAGGGAAAATGGGATTGCTGCTTTAAATTTCTGAGCTAGGGATTTTTTGGCAGCTGCAGTGTTGGCGACTATTGTAAAATTCTCTTTGTTTCTCTCTGTAAATAGCACCTGCTAACATTACAATTTGTATTTATGTTTAAAGAAGGCATCATTTGGTGAACAGAACTAGGAAATGAATTTTTAGCTCTTAAAAGCATTTGCTTTGAGACCGCACAGGAGTGTCTTTCCTTGTAAAACAGTGATGATAATTTCTGCCTTGGCCCTACCTTGAAGCAATGTTGTGTGAAGGGATGAAGAATCTAAAAGTCTTCATAAGTCCTTGGGAGAGGTGCTAGAAAAATATAAGGCACTATCATAATTACAGTGATGTCCTTGCTGTTACTACTCAAATCACCCACAAATTTCCCCAAAGACTGCGCTAGCTGTCAAATAAAAGACAGTGAAATTGACCTG

SEQ ID NO: 2 - protein, 822 aa, Homo sapiens [sequence omitted]

SEQ ID NO: 3 - protein, 5702 aa, Homo sapiens
GCCGGCGCATAGCGCTCGGAGCGCTCTTGCGGCCACAGGCGCGGCGTCCTCGGCGGCGGGCGGCAGCTAGCGGGAGCCGGGACGCCGGTGCAGCCGCAGCGCGCGGAGGAACCCGGGTGTGCCGGGAGCTGGGCGGCCACGTCCGGACGGGACCGAGACCCCTCGTAGCGCATTGCGGCGACCTCGCCTTCCCCGGCCGCGAGCGCGCCGCTGCTTGAAAAGCCGCGGAACCCAAGGACTTTTCTCCGGTCCGAGCTCGGGGCGCCCCGCAGGGCGCACGGTACCCGTGCTGCAGTCGGGCACGCCGCGGCGCCGGGGCCTCCGCAGGGCGATGGAGCCCGGTCTGCAAGGAAAGTGAGGCGCCGCCGCTGCGTTCTGGAGGAGGGGGGCACAAGGTCTGGAGACCCCGGGTGGCGGACGGGAGCCCTCCCCCCGCCCCGCCTCCGGGGCACCAGCTCCGGCTCCATTGTTCCCGCCCGGGCTGGAGGCGCCGAGCACCGAGCGCCGCCGGGAGTCGAGCGCCGGCCGCGGAGCTCTTGCGACCCCGCCAGGACCCGAACAGAGCCCGGGGGCGGCGGGCCGGAGCCGGGGACGCGGGCACACGCCCGCTCGCACAAGCCACGGCGGACTCTCCCGAGGCGGAACCTCCACGCCGAGCGAGGGTCAGTTTGAAAAGGAGGATCGAGCTCACTGTGGAGTATCCATGGAGATGTGGAGCCTTGTCACCAACCTCTAACTGCAGAACTGGGATGTGGAGCTGGAAGTGCCTCCTCTTCTGGGCTGTGCTGGTCACAGCCACACTCTGCACCGCTAGGCCGTCCCCGACCTTGCCTGAACAAGCCCAGCCCTGGGGAGCCCCTGTGGAAGTGGAGTCCTTCCTGGTCCACCCCGGTGACCTGCTGCAGCTTCGCTGTCGGCTGCGGGACGATGTGCAGAGCATCAACTGGCTGCGGGACGGGGTGCAGCTGGCGGAAAGCAACCGCACCCGCATCACAGGGGAGGAGGTGGAGGTGCAGGACTCCGTGCCCGCAGACTCCGGCCTCTATGCTTGCGTAACCAGCAGCCCCTCGGGCAGTGACACCACCTACTTCTCCGTCAATGTTTCAGATGCTCTCCCCTCCTCGGAGGATGATGATGATGATGATGACTCCTCTTCAGAGGAGAAAGAAACAGATAACACCAAACCAAACCCCGTAGCTCCATATTGGACATCCCCAGAAAAGATGGAAAAGAAATTGCATGCAGTGCCGGCTGCCAAGACAGTGAAGTTCAAATGCCCTTCCAGTGGGACCCCAAACCCCACACTGCGCTGGTTGAAAAATGGCAAAGAATTCAAACCTGACCACAGAATTGGAGGCTACAAGGTCCGTTATGCCACCTGGAGCATCATAATGGACTCTGTGGTGCCCTCTGACAAGGGCAACTACACCTGCATTGTGGAGAATGAGTACGGCAGCATCAACCACACATACCAGCTGGATGTCGTGGAGCGGTCCCCTCACCGGCCCATCCTGCAAGCAGGGTTGCCCGCCAACAAAACAGTGGCCCTGGGTAGCAACGTGGAGTTCATGTGTAAGGTGTACAGTGACCCGCAGCCGCACATCCAGTGGCTAAAGCACATCGAGGTGAATGGGAGCAAGATTGGCCCAGACAACCTGCCTTATGTCCAGATCTTGAAGACTGCTGGAGTTAATACCACCGACAAAGAGATGGAGGTGCTTCACTTAAGAAATGTCTCCTTTGAGGACGCAGGGGAGTATACGTGCTTGGCGGGTAACTCTATCGGACTCTCCCATCACTCTGCATGGTTGACCGTTCTGGAAGCCCTGGAAGAGAGGCCGGCAGTGATGACCTCGCCCCTGTACCTGGAGATCATCATCTATTGCACAGGGGCCTTCCTCATCTCCTGCATGGTGGGGTCGGTCATCGTCTACAAGATGAAGAGTGGTACCAAGAAGAGTGACTTCCACAGCCAGATGGCTGTGCACAAGCTGGCCAAGAGCATCCCTCTGCGCAGACAGGTAACAGTGTCTGCTGACTCCAGTGCATCCATGAACTCTGGGGTTCTTCTGGTTCGGCCATCACGGCTCTCCTCCAGTGGGACTCCCATGCTAGCAGGGGTCTCTGAGTATGAGCTTCCCGAAGACCCTCGCTGGGAGCTGCCTCGGGACAGACTGGTCTTAGGCAAACCCCTGGGAGAGGGCTGCTTTGGGCAGGTGGTGTTGGCAGAGGCTATCGGGCTGGACAAGGACAAACCCAACCGTGTGACCAAAGTGGCTGTGAAGATGTTGAAGTCGGACGCAACAGAGAAAGACTTGTCAGACCTGATCTCAGAAATGGAGATGATGAAGATGATCGGGAAGCATAAGAATATCATCAACCTGCTGGGGGCCTGCACGCAGGATGGTCCCTTGTATGTCATCGTGGAGTATGCCTCCAAGGGCAACCTGCGGGAGTACCTGCAGGCCCGGAGGCCCCCAGGGCTGGAATACTGCTACAACCCCAGCCACAACCCAGAGGAGCAGCTCTCCTCCAAGGACCTGGTGTCCTGCGCCTACCAGGTGGCCCGAGGCATGGAGTATCTGGCCTCCAAGAAGTGCATACACCGAGACCTGGCAGCCAGGAATGTCCTGGTGACAGAGGACAATGTGATGAAGATAGCAGACTTTGGCCTCGCACGGGACATTCACCACATCGACTACTATAAAAAGACAACCAACGGCCGACTGCCTGTGAAGTGGATGGCACCCGAGGCATTATTTGACCGGATCTACACCCACCAGAGTGATGTGTGGTCTTTCGGGGTGCTCCTGTGGGAGATCTTCACTCTGGGCGGCTCCCCATACCCCGGTGTGCCTGTGGAGGAACTTTTCAAGCTGCTGAAGGAGGGTCACCGCATGGACAAGCCCAGTAACTGCACCAACGAGCTGTACATGATGATGCGGGACTGCTGGCATGCAGTGCCCTCACAGAGACCCACCTTCAAGCAGCTGGTGGAAGACCTGGACCGCATCGTGGCCTTGACCTCCAACCAGGAGTACCTGGACCTGTCCATGCCCCTGGACCAGTACTCCCCCAGCTTTCCCGACACCCGGAGCTCTACGTGCTCCTCAGGGGAGGATTCCGTCTTCTCTCATGAGCCGCTGCCCGAGGAGCCCTGCCTGCCCCGACACCCAGCCCAGCTTGCCAATGGCGGACTCAAACGCCGCTGACTGCCACCCACACGCCCTCCCCAGACTCCACCGTCAGCTGTAACCCTCACCCACAGCCCCTGCTGGGCCCACCACCTGTCCGTCCCTGTCCCCTTTCCTGCTGGCAGGAGCCGGCTGCCTACCAGGGGCCTTCCTGTGTGGCCTGCCTTCACCCCACTCAGCTCACCTCTCCCTCCACCTCCTCTCCACCTGCTGGTGAGAGGTGCAAAGAGGCAGATCTTTGCTGCCAGCCACTTCATCCCCTCCCAGATGTTGGACCAACACCCCTCCCTGCCACCAGGCACTGCCTGGAGGGCAGGGAGTGGGAGCCAATGAACAGGCATGCAAGTGAGAGCTTCCTGAGCTTTCTCCTGTCGGTTTGGTCTGTTTTGCCTTCACCCATAAGCCCCTCGCACTCTGGTGGCAGGTGCCTTGTCCTCAGGGCTACAGCAGTAGGGAGGTCAGTGCTTCGTGCCTCGATTGAAGGTGACCTCTGCCCCAGATAGGTGGTGCCAGTGGCTTATTAATTCCGATACTAGTTTGCTTTGCTGACCAAATGCCTGGTACCAGAGGATGGTGAGGCGAAGGCCAGGTTGGGGGCAGTGTTGTGGCCCTGGGGCCCAGCCCCAAACTGGGGGCTCTGTATATAGCTATGAAGAAAACACAAAGTGTATAAATCTGAGTATATATTTACATGTCTTTTTAAAAGGGTCGTTACCAGAGATTTACCCATCGGGTAAGATGCTCCTGGTGGCTGGGAGGCATCAGTTGCTATATATTAAAAACAAAAAAGAAAAAAAAGGAAAATGTTTTTAAAAAGGTCATATATTTTTTGCTACTTTTGCTGTTTTATTTTTTTAAATTATGTTCTAAACCTATTTTCAGTTTAGGTCCCTCAATAAAAATTGCTGCTGCTTCATTTATCTATGGGCTGTATGAAAAGGGTGGGAATGTCCACTGGAAAGAAGGGACACCCACGGGCCCTGGGGCTAGGTCTGTCCCGAGGGCACCGCATGCTCCCGGCGCAGGTTCCTTGTAACCTCTTCTTCCTAGGTCCTGCACCCAGACCTCACGACGCACCTCCTGCCTCTCCGCTGCTTTTGGAAAGTCAGAAAAAGAAGATGTCTGCTTCGAGGGCAGGAACCCCATCCATGCAGTAGAGGCGCTGGGCAGAGAGTCAAGGCCCAGCAGCCATCGACCATGGATGGTTTCCTCCAAGGAAACCGGTGGGGTTGGGCTGGGGAGGGGGCACCTACCTAGGAATAGCCACGGGGTAGAGCTACAGTGATTAAGAGGAAAGCAAGGGCGCGGTTGCTCACGCCTGTAATCCCAGCACTTTGGGACACCGAGGTGGGCAGATCACTTCAGGTCAGGAGTTTGAGACCAGCCTGGCCAACTTAGTGAAACCCCATCTCTACTAAAAATGCAAAAATTATCCAGGCATGGTGGCACACGCCTGTAATCCCAGCTCCACAGGAGGCTGAGGCAGAATCCCTTGAAGCTGGGAGGCGGAGGTTGCAGTGAGCCGAGATTGCGCCATTGCACTCCAGCCTGGGCAACAGAGAAAACAAAAAGGAAAACAAATGATGAAGGTCTGCAGAAACTGAAACCCAGACATGTGTCTGCCCCCTCTATGTGGGCATGGTTTTGCCAGTGCTTCTAAGTGCAGGAGAACATGTCACCTGAGGCTAGTTTTGCATTCAGGTCCCTGGCTTCGTTTCTTGTTGGTATGCCTCCCCAGATCGTCCTTCCTGTATCCATGTGACCAGACTGTATTTGTTGGGACTGTCGCAGATCTTGGCTTCTTACAGTTCTTCCTGTCCAAACTCCATCCTGTCCCTCAGGAACGGGGGGAAAATTCTCCGAATGTTTTTGGTTTTTTGGCTGCTTGGAATTTACTTCTGCCACCTGCTGGTCATCACTGTCCTCACTAAGTGGATTCTGGCTCCCCCGTACCTCATGGCTCAAACTACCACTCCTCAGTCGCTATATTAAAGCTTATATTTTGCTGGATTACTGCTAAATACAAAAGAAAGTTCAATATGTTTTCATTTCTGTAGGGAAAATGGGATTGCTGCTTTAAATTTCTGAGCTAGGGATTTTTTGGCAGCTGCAGTGTTGGCGACTATTGTAAAATTCTCTTTGTTTCTCTCTGTAAATAGCACCTGCTAACATTACAATTTGTATTTATGTTTAAAGAAGGCATCATTTGGTGAACAGAACTAGGAAATGAATTTTTAGCTCTTAAAAGCATTTGCTTTGAGACCGCACAGGAGTGTCTTTCCTTGTAAAACAGTGATGATAATTTCTGCCTTGGCCCTACCTTGAAGCAATGTTGTGTGAAGGGATGAAGAATCTAAAAGTCTTCATAAGTCCTTGGGAGAGGTGCTAGAAAAATATAAGGCACTATCATAATTACAGTGATGTCCTTGCTGTTACTACTCAAATCACCCACAAATTTCCCCAAAGACTGCGCTAGCTGTCAAATAAAAGACAGTGAAATTGACCTGA

SEQ ID NO: 4 - protein, 820 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 5 - protein, 5590 aa, Homo sapiens
AGCGCTCTTGCGGCCACAGGCGCGGCGTCCTCGGCGGCGGGCGGCAGCTAGCGGGAGCCGGGACGCCGGTGCAGCCGCAGCGCGCGGAGGAACCCGGGTGTGCCGGGAGCTGGGCGGCCACGTCCGGACGGGACCGAGACCCCTCGTAGCGCATTGCGGCGACCTCGCCTTCCCCGGCCGCGAGCGCGCCGCTGCTTGAAAAGCCGCGGAACCCAAGGACTTTTCTCCGGTCCGAGCTCGGGGCGCCCCGCAGGGCGCACGGTACCCGTGCTGCAGTCGGGCACGCCGCGGCGCCGGGGCCTCCGCAGGGCGATGGAGCCCGGTCTGCAAGGAAAGTGAGGCGCCGCCGCTGCGTTCTGGAGGAGGGGGGCACAAGGTCTGGAGACCCCGGGTGGCGGACGGGAGCCCTCCCCCCGCCCCGCCTCCGGGGCACCAGCTCCGGCTCCATTGTTCCCGCCCGGGCTGGAGGCGCCGAGCACCGAGCGCCGCCGGGAGTCGAGCGCCGGCCGCGGAGCTCTTGCGACCCCGCCAGGACCCGAACAGAGCCCGGGGGCGGCGGGCCGGAGCCGGGGACGCGGGCACACGCCCGCTCGCACAAGCCACGGCGGACTCTCCCGAGGCGGAACCTCCACGCCGAGCGAGGGTCAGTTTGAAAAGGAGGATCGAGCTCACTGTGGAGTATCCATGGAGATGTGGAGCCTTGTCACCAACCTCTAACTGCAGAACTGGGATGTGGAGCTGGAAGTGCCTCCTCTTCTGGGCTGTGCTGGTCACAGCCACACTCTGCACCGCTAGGCCGTCCCCGACCTTGCCTGAACAAGCCCAGCCCTGGGGAGCCCCTGTGGAAGTGGAGTCCTTCCTGGTCCACCCCGGTGACCTGCTGCAGCTTCGCTGTCGGCTGCGGGACGATGTGCAGAGCATCAACTGGCTGCGGGACGGGGTGCAGCTGGCGGAAAGCAACCGCACCCGCATCACAGGGGAGGAGGTGGAGGTGCAGGACTCCGTGCCCGCAGACTCCGGCCTCTATGCTTGCGTAACCAGCAGCCCCTCGGGCAGTGACACCACCTACTTCTCCGTCAATGTTTCAGATGCTCTCCCCTCCTCGGAGGATGATGATGATGATGATGACTCCTCTTCAGAGGAGAAAGAAACAGATAACACCAAACCAAACCGTATGCCCGTAGCTCCATATTGGACATCCCCAGAAAAGATGGAAAAGAAATTGCATGCAGTGCCGGCTGCCAAGACAGTGAAGTTCAAATGCCCTTCCAGTGGGACCCCAAACCCCACACTGCGCTGGTTGAAAAATGGCAAAGAATTCAAACCTGACCACAGAATTGGAGGCTACAAGGTCCGTTATGCCACCTGGAGCATCATAATGGACTCTGTGGTGCCCTCTGACAAGGGCAACTACACCTGCATTGTGGAGAATGAGTACGGCAGCATCAACCACACATACCAGCTGGATGTCGTGGAGCGGTCCCCTCACCGGCCCATCCTGCAAGCAGGGTTGCCCGCCAACAAAACAGTGGCCCTGGGTAGCAACGTGGAGTTCATGTGTAAGGTGTACAGTGACCCGCAGCCGCACATCCAGTGGCTAAAGCACATCGAGGTGAATGGGAGCAAGATTGGCCCAGACAACCTGCCTTATGTCCAGATCTTGAAGACTGCTGGAGTTAATACCACCGACAAAGAGATGGAGGTGCTTCACTTAAGAAATGTCTCCTTTGAGGACGCAGGGGAGTATACGTGCTTGGCGGGTAACTCTATCGGACTCTCCCATCACTCTGCATGGTTGACCGTTCTGGAAGCCCTGGAAGAGAGGCCGGCAGTGATGACCTCGCCCCTGTACCTGGAGATCATCATCTATTGCACAGGGGCCTTCCTCATCTCCTGCATGGTGGGGTCGGTCATCGTCTACAAGATGAAGAGTGGTACCAAGAAGAGTGACTTCCACAGCCAGATGGCTGTGCACAAGCTGGCCAAGAGCATCCCTCTGCGCAGACAGGTGTCTGCTGACTCCAGTGCATCCATGAACTCTGGGGTTCTTCTGGTTCGGCCATCACGGCTCTCCTCCAGTGGGACTCCCATGCTAGCAGGGGTCTCTGAGTATGAGCTTCCCGAAGACCCTCGCTGGGAGCTGCCTCGGGACAGACTGGTCTTAGGCAAACCCCTGGGAGAGGGCTGCTTTGGGCAGGTGGTGTTGGCAGAGGCTATCGGGCTGGACAAGGACAAACCCAACCGTGTGACCAAAGTGGCTGTGAAGATGTTGAAGTCGGACGCAACAGAGAAAGACTTGTCAGACCTGATCTCAGAAATGGAGATGATGAAGATGATCGGGAAGCATAAGAATATCATCAACCTGCTGGGGGCCTGCACGCAGGATGGTCCCTTGTATGTCATCGTGGAGTATGCCTCCAAGGGCAACCTGCGGGAGTACCTGCAGGCCCGGAGGCCCCCAGGGCTGGAATACTGCTACAACCCCAGCCACAACCCAGAGGAGCAGCTCTCCTCCAAGGACCTGGTGTCCTGCGCCTACCAGGTGGCCCGAGGCATGGAGTATCTGGCCTCCAAGAAGTGCATACACCGAGACCTGGCAGCCAGGAATGTCCTGGTGACAGAGGACAATGTGATGAAGATAGCAGACTTTGGCCTCGCACGGGACATTCACCACATCGACTACTATAAAAAGACAACCAACGGCCGACTGCCTGTGAAGTGGATGGCACCCGAGGCATTATTTGACCGGATCTACACCCACCAGAGTGATGTGTGGTCTTTCGGGGTGCTCCTGTGGGAGATCTTCACTCTGGGCGGCTCCCCATACCCCGGTGTGCCTGTGGAGGAACTTTTCAAGCTGCTGAAGGAGGGTCACCGCATGGACAAGCCCAGTAACTGCACCAACGAGCTGTACATGATGATGCGGGACTGCTGGCATGCAGTGCCCTCACAGAGACCCACCTTCAAGCAGCTGGTGGAAGACCTGGACCGCATCGTGGCCTTGACCTCCAACCAGGAGTACCTGGACCTGTCCATGCCCCTGGACCAGTACTCCCCCAGCTTTCCCGACACCCGGAGCTCTACGTGCTCCTCAGGGGAGGATTCCGTCTTCTCTCATGAGCCGCTGCCCGAGGAGCCCTGCCTGCCCCGACACCCAGCCCAGCTTGCCAATGGCGGACTCAAACGCCGCTGACTGCCACCCACACGCCCTCCCCAGACTCCACCGTCAGCTGTAACCCTCACCCACAGCCCCTGCTGGGCCCACCACCTGTCCGTCCCTGTCCCCTTTCCTGCTGGCAGGAGCCGGCTGCCTACCAGGGGCCTTCCTGTGTGGCCTGCCTTCACCCCACTCAGCTCACCTCTCCCTCCACCTCCTCTCCACCTGCTGGTGAGAGGTGCAAAGAGGCAGATCTTTGCTGCCAGCCACTTCATCCCCTCCCAGATGTTGGACCAACACCCCTCCCTGCCACCAGGCACTGCCTGGAGGGCAGGGAGTGGGAGCCAATGAACAGGCATGCAAGTGAGAGCTTCCTGAGCTTTCTCCTGTCGGTTTGGTCTGTTTTGCCTTCACCCATAAGCCCCTCGCACTCTGGTGGCAGGTGCCTTGTCCTCAGGGCTACAGCAGTAGGGAGGTCAGTGCTTCGTGCCTCGATTGAAGGTGACCTCTGCCCCAGATAGGTGGTGCCAGTGGCTTATTAATTCCGATACTAGTTTGCTTTGCTGACCAAATGCCTGGTACCAGAGGATGGTGAGGCGAAGGCCAGGTTGGGGGCAGTGTTGTGGCCCTGGGGCCCAGCCCCAAACTGGGGGCTCTGTATATAGCTATGAAGAAAACACAAAGTGTATAAATCTGAGTATATATTTACATGTCTTTTTAAAAGGGTCGTTACCAGAGATTTACCCATCGGGTAAGATGCTCCTGGTGGCTGGGAGGCATCAGTTGCTATATATTAAAAACAAAAAAGAAAAAAAAGGAAAATGTTTTTAAAAAGGTCATATATTTTTTGCTACTTTTGCTGTTTTATTTTTTTAAATTATGTTCTAAACCTATTTTCAGTTTAGGTCCCTCAATAAAAATTGCTGCTGCTTCATTTATCTATGGGCTGTATGAAAAGGGTGGGAATGTCCACTGGAAAGAAGGGACACCCACGGGCCCTGGGGCTAGGTCTGTCCCGAGGGCACCGCATGCTCCCGGCGCAGGTTCCTTGTAACCTCTTCTTCCTAGGTCCTGCACCCAGACCTCACGACGCACCTCCTGCCTCTCCGCTGCTTTTGGAAAGTCAGAAAAAGAAGATGTCTGCTTCGAGGGCAGGAACCCCATCCATGCAGTAGAGGCGCTGGGCAGAGAGTCAAGGCCCAGCAGCCATCGACCATGGATGGTTTCCTCCAAGGAAACCGGTGGGGTTGGGCTGGGGAGGGGGCACCTACCTAGGAATAGCCACGGGGTAGAGCTACAGTGATTAAGAGGAAAGCAAGGGCGCGGTTGCTCACGCCTGTAATCCCAGCACTTTGGGACACCGAGGTGGGCAGATCACTTCAGGTCAGGAGTTTGAGACCAGCCTGGCCAACTTAGTGAAACCCCATCTCTACTAAAAATGCAAAAATTATCCAGGCATGGTGGCACACGCCTGTAATCCCAGCTCCACAGGAGGCTGAGGCAGAATCCCTTGAAGCTGGGAGGCGGAGGTTGCAGTGAGCCGAGATTGCGCCATTGCACTCCAGCCTGGGCAACAGAGAAAACAAAAAGGAAAACAAATGATGAAGGTCTGCAGAAACTGAAACCCAGACATGTGTCTGCCCCCTCTATGTGGGCATGGTTTTGCCAGTGCTTCTAAGTGCAGGAGAACATGTCACCTGAGGCTAGTTTTGCATTCAGGTCCCTGGCTTCGTTTCTTGTTGGTATGCCTCCCCAGATCGTCCTTCCTGTATCCATGTGACCAGACTGTATTTGTTGGGACTGTCGCAGATCTTGGCTTCTTACAGTTCTTCCTGTCCAAACTCCATCCTGTCCCTCAGGAACGGGGGGAAAATTCTCCGAATGTTTTTGGTTTTTTGGCTGCTTGGAATTTACTTCTGCCACCTGCTGGTCATCACTGTCCTCACTAAGTGGATTCTGGCTCCCCCGTACCTCATGGCTCAAACTACCACTCCTCAGTCGCTATATTAAAGCTTATATTTTGCTGGATTACTGCTAAATACAAAAGAAAGTTCAATATGTTTTCATTTCTGTAGGGAAAATGGGATTGCTGCTTTAAATTTCTGAGCTAGGGATTTTTTGGCAGCTGCAGTGTTGGCGACTATTGTAAAATTCTCTTTGTTTCTCTCTGTAAATAGCACCTGCTAACATTACAATTTGTATTTATGTTTAAAGAAGGCATCATTTGGTGAACAGAACTAGGAAATGAATTTTTAGCTCTTAAAAGCATTTGCTTTGAGACCGCACAGGAGTGTCTTTCCTTGTAAAACAGTGATGATAATTTCTGCCTTGGCCCTACCTTGAAGCAATGTTGTGTGAAGGGATGAAGAATCTAAAAGTCTTCATAAGTCCTTGGGAGAGGTGCTAGAAAAATATAAGGCACTATCATAATTA

SEQ ID NO: 6 - protein, 820 aa, Homo sapiens
MWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 7 - protein, 5375 aa, Homo sapiens
CCCTTTCACCTCCTGGCTCCCTCCCGGGCGATCCGCGCCCCTTGGGTCTCCCCTCCCTTCCCTCCGTCCGCGTCTCCTGCGCCCCCTCCCTGCGCTCGTCCCGCCGCTCTTCCCGCCGCCCAACTTTTCCTCCAACTCGCGCTCGGGAGCTGGCGAGGCGGCGGCGGCTCCTCAAAGTGGGAGAGCTTCAAGGTCACGTGGTCCGTCCAGCCCCTGCTATCTCACCAGACACTGTCCACCCTGTATGTTGGATCAGTACTCCAGTGAGAAGACAGCAGGCACTTTCACCCATGCAGCCCATTCAGTCTTCATAACCACCTGTGATGGAGGCAAGGGTCAGTTTGAAAAGGAGGATCGAGCTCACTGTGGAGTATCCATGGAGATGTGGAGCCTTGTCACCAACCTCTAACTGCAGAACTGGGATGTGGAGCTGGAAGTGCCTCCTCTTCTGGGCTGTGCTGGTCACAGCCACACTCTGCACCGCTAGGCCGTCCCCGACCTTGCCTGAACAAGCCCAGCCCTGGGGAGCCCCTGTGGAAGTGGAGTCCTTCCTGGTCCACCCCGGTGACCTGCTGCAGCTTCGCTGTCGGCTGCGGGACGATGTGCAGAGCATCAACTGGCTGCGGGACGGGGTGCAGCTGGCGGAAAGCAACCGCACCCGCATCACAGGGGAGGAGGTGGAGGTGCAGGACTCCGTGCCCGCAGACTCCGGCCTCTATGCTTGCGTAACCAGCAGCCCCTCGGGCAGTGACACCACCTACTTCTCCGTCAATGTTTCAGATGCTCTCCCCTCCTCGGAGGATGATGATGATGATGATGACTCCTCTTCAGAGGAGAAAGAAACAGATAACACCAAACCAAACCCCGTAGCTCCATATTGGACATCCCCAGAAAAGATGGAAAAGAAATTGCATGCAGTGCCGGCTGCCAAGACAGTGAAGTTCAAATGCCCTTCCAGTGGGACCCCAAACCCCACACTGCGCTGGTTGAAAAATGGCAAAGAATTCAAACCTGACCACAGAATTGGAGGCTACAAGGTCCGTTATGCCACCTGGAGCATCATAATGGACTCTGTGGTGCCCTCTGACAAGGGCAACTACACCTGCATTGTGGAGAATGAGTACGGCAGCATCAACCACACATACCAGCTGGATGTCGTGGAGCGGTCCCCTCACCGGCCCATCCTGCAAGCAGGGTTGCCCGCCAACAAAACAGTGGCCCTGGGTAGCAACGTGGAGTTCATGTGTAAGGTGTACAGTGACCCGCAGCCGCACATCCAGTGGCTAAAGCACATCGAGGTGAATGGGAGCAAGATTGGCCCAGACAACCTGCCTTATGTCCAGATCTTGAAGACTGCTGGAGTTAATACCACCGACAAAGAGATGGAGGTGCTTCACTTAAGAAATGTCTCCTTTGAGGACGCAGGGGAGTATACGTGCTTGGCGGGTAACTCTATCGGACTCTCCCATCACTCTGCATGGTTGACCGTTCTGGAAGCCCTGGAAGAGAGGCCGGCAGTGATGACCTCGCCCCTGTACCTGGAGATCATCATCTATTGCACAGGGGCCTTCCTCATCTCCTGCATGGTGGGGTCGGTCATCGTCTACAAGATGAAGAGTGGTACCAAGAAGAGTGACTTCCACAGCCAGATGGCTGTGCACAAGCTGGCCAAGAGCATCCCTCTGCGCAGACAGGTAACAGTGTCTGCTGACTCCAGTGCATCCATGAACTCTGGGGTTCTTCTGGTTCGGCCATCACGGCTCTCCTCCAGTGGGACTCCCATGCTAGCAGGGGTCTCTGAGTATGAGCTTCCCGAAGACCCTCGCTGGGAGCTGCCTCGGGACAGACTGGTCTTAGGCAAACCCCTGGGAGAGGGCTGCTTTGGGCAGGTGGTGTTGGCAGAGGCTATCGGGCTGGACAAGGACAAACCCAACCGTGTGACCAAAGTGGCTGTGAAGATGTTGAAGTCGGACGCAACAGAGAAAGACTTGTCAGACCTGATCTCAGAAATGGAGATGATGAAGATGATCGGGAAGCATAAGAATATCATCAACCTGCTGGGGGCCTGCACGCAGGATGGTCCCTTGTATGTCATCGTGGAGTATGCCTCCAAGGGCAACCTGCGGGAGTACCTGCAGGCCCGGAGGCCCCCAGGGCTGGAATACTGCTACAACCCCAGCCACAACCCAGAGGAGCAGCTCTCCTCCAAGGACCTGGTGTCCTGCGCCTACCAGGTGGCCCGAGGCATGGAGTATCTGGCCTCCAAGAAGTGCATACACCGAGACCTGGCAGCCAGGAATGTCCTGGTGACAGAGGACAATGTGATGAAGATAGCAGACTTTGGCCTCGCACGGGACATTCACCACATCGACTACTATAAAAAGACAACCAACGGCCGACTGCCTGTGAAGTGGATGGCACCCGAGGCATTATTTGACCGGATCTACACCCACCAGAGTGATGTGTGGTCTTTCGGGGTGCTCCTGTGGGAGATCTTCACTCTGGGCGGCTCCCCATACCCCGGTGTGCCTGTGGAGGAACTTTTCAAGCTGCTGAAGGAGGGTCACCGCATGGACAAGCCCAGTAACTGCACCAACGAGCTGTACATGATGATGCGGGACTGCTGGCATGCAGTGCCCTCACAGAGACCCACCTTCAAGCAGCTGGTGGAAGACCTGGACCGCATCGTGGCCTTGACCTCCAACCAGGAGTACCTGGACCTGTCCATGCCCCTGGACCAGTACTCCCCCAGCTTTCCCGACACCCGGAGCTCTACGTGCTCCTCAGGGGAGGATTCCGTCTTCTCTCATGAGCCGCTGCCCGAGGAGCCCTGCCTGCCCCGACACCCAGCCCAGCTTGCCAATGGCGGACTCAAACGCCGCTGACTGCCACCCACACGCCCTCCCCAGACTCCACCGTCAGCTGTAACCCTCACCCACAGCCCCTGCTGGGCCCACCACCTGTCCGTCCCTGTCCCCTTTCCTGCTGGCAGGAGCCGGCTGCCTACCAGGGGCCTTCCTGTGTGGCCTGCCTTCACCCCACTCAGCTCACCTCTCCCTCCACCTCCTCTCCACCTGCTGGTGAGAGGTGCAAAGAGGCAGATCTTTGCTGCCAGCCACTTCATCCCCTCCCAGATGTTGGACCAACACCCCTCCCTGCCACCAGGCACTGCCTGGAGGGCAGGGAGTGGGAGCCAATGAACAGGCATGCAAGTGAGAGCTTCCTGAGCTTTCTCCTGTCGGTTTGGTCTGTTTTGCCTTCACCCATAAGCCCCTCGCACTCTGGTGGCAGGTGCCTTGTCCTCAGGGCTACAGCAGTAGGGAGGTCAGTGCTTCGTGCCTCGATTGAAGGTGACCTCTGCCCCAGATAGGTGGTGCCAGTGGCTTATTAATTCCGATACTAGTTTGCTTTGCTGACCAAATGCCTGGTACCAGAGGATGGTGAGGCGAAGGCCAGGTTGGGGGCAGTGTTGTGGCCCTGGGGCCCAGCCCCAAACTGGGGGCTCTGTATATAGCTATGAAGAAAACACAAAGTGTATAAATCTGAGTATATATTTACATGTCTTTTTAAAAGGGTCGTTACCAGAGATTTACCCATCGGGTAAGATGCTCCTGGTGGCTGGGAGGCATCAGTTGCTATATATTAAAAACAAAAAAGAAAAAAAAGGAAAATGTTTTTAAAAAGGTCATATATTTTTTGCTACTTTTGCTGTTTTATTTTTTTAAATTATGTTCTAAACCTATTTTCAGTTTAGGTCCCTCAATAAAAATTGCTGCTGCTTCATTTATCTATGGGCTGTATGAAAAGGGTGGGAATGTCCACTGGAAAGAAGGGACACCCACGGGCCCTGGGGCTAGGTCTGTCCCGAGGGCACCGCATGCTCCCGGCGCAGGTTCCTTGTAACCTCTTCTTCCTAGGTCCTGCACCCAGACCTCACGACGCACCTCCTGCCTCTCCGCTGCTTTTGGAAAGTCAGAAAAAGAAGATGTCTGCTTCGAGGGCAGGAACCCCATCCATGCAGTAGAGGCGCTGGGCAGAGAGTCAAGGCCCAGCAGCCATCGACCATGGATGGTTTCCTCCAAGGAAACCGGTGGGGTTGGGCTGGGGAGGGGGCACCTACCTAGGAATAGCCACGGGGTAGAGCTACAGTGATTAAGAGGAAAGCAAGGGCGCGGTTGCTCACGCCTGTAATCCCAGCACTTTGGGACACCGAGGTGGGCAGATCACTTCAGGTCAGGAGTTTGAGACCAGCCTGGCCAACTTAGTGAAACCCCATCTCTACTAAAAATGCAAAAATTATCCAGGCATGGTGGCACACGCCTGTAATCCCAGCTCCACAGGAGGCTGAGGCAGAATCCCTTGAAGCTGGGAGGCGGAGGTTGCAGTGAGCCGAGATTGCGCCATTGCACTCCAGCCTGGGCAACAGAGAAAACAAAAAGGAAAACAAATGATGAAGGTCTGCAGAAACTGAAACCCAGACATGTGTCTGCCCCCTCTATGTGGGCATGGTTTTGCCAGTGCTTCTAAGTGCAGGAGAACATGTCACCTGAGGCTAGTTTTGCATTCAGGTCCCTGGCTTCGTTTCTTGTTGGTATGCCTCCCCAGATCGTCCTTCCTGTATCCATGTGACCAGACTGTATTTGTTGGGACTGTCGCAGATCTTGGCTTCTTACAGTTCTTCCTGTCCAAACTCCATCCTGTCCCTCAGGAACGGGGGGAAAATTCTCCGAATGTTTTTGGTTTTTTGGCTGCTTGGAATTTACTTCTGCCACCTGCTGGTCATCACTGTCCTCACTAAGTGGATTCTGGCTCCCCCGTACCTCATGGCTCAAACTACCACTCCTCAGTCGCTATATTAAAGCTTATATTTTGCTGGATTACTGCTAAATACAAAAGAAAGTTCAATATGTTTTCATTTCTGTAGGGAAAATGGGATTGCTGCTTTAAATTTCTGAGCTAGGGATTTTTTGGCAGCTGCAGTGTTGGCGACTATTGTAAAATTCTCTTTGTTTCTCTCTGTAAATAGCACCTGCTAACATTACAATTTGTATTTATGTTTAAAGAAGGCATCATTTGGTGAACAGAACTAGGAAATGAATTTTTAGCTCTTAAAAGCATTTGCTTTGAGACCGCACAGGAGTGTCTTTCCTTGTAAAACAGTGATGATAATTTCTGCCTTGGCCCTACCTTGAAGCAATGTTGTGTGAAGGGATGAAGAATCTAAAAGTCTTCATAAGTCCTTGGGAGAGGTGCTAGAAAAATATAAGGCACTATCATAATTACAGTGATGTCCTTGCTGTTACTACTCAAATCACCCACAAATTTCCCCAAAGACTGCGCTAGCTGTCAAATAAAAGACAGTGAAATTGACCTGA

SEQ ID NO: 8 - protein, 853 aa, Homo sapiens
MEARVSLKRRIELTVEYPWRCGALSPTSNCRTGMWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 9 - protein, 4157 aa, Homo sapiens
GCGCTCTTGCGGCCACAGGCGCGGCGTCCTCGGCGGCGGGCGGCAGCTAGCGGGAGCCGGGACGCCGGTGCAGCCGCAGCGCGCGGAGGAACCCGGGTGTGCCGGGAGCTGGGCGGCCACGTCCGGACGGGACCGAGACCCCTCGTAGCGCATTGCGGCGACCTCGCCTTCCCCGGCCGCGAGCGCGCCGCTGCTTGAAAAGCCGCGGAACCCAAGGACTTTTCTCCGGTCCGAGCTCGGGGCGCCCCGCAGGGCGCACGGTACCCGTGCTGCAGTCGGGCACGCCGCGGCGCCGGGGCCTCCGCAGGGCGATGGAGCCCGGTCTGCAAGGAAAGTGAGGCGCCGCCGCTGCGTTCTGGAGGAGGGGGGCACAAGGTCTGGAGACCCCGGGTGGCGGACGGGAGCCCTCCCCCCGCCCCGCCTCCGGGGCACCAGCTCCGGCTCCATTGTTCCCGCCCGGGCTGGAGGCGCCGAGCACCGAGCGCCGCCGGGAGTCGAGCGCCGGCCGCGGAGCTCTTGCGACCCCGCCAGGACCCGAACAGAGCCCGGGGGCGGCGGGCCGGAGCCGGGGACGCGGGCACACGCCCGCTCGCACAAGCCACGGCGGACTCTCCCGAGGCGGAACCTCCACGCCGAGCGAGGGTCAGTTTGAAAAGGAGGATCGAGCTCACTGTGGAGTATCCATGGAGATGTGGAGCCTTGTCACCAACCTCTAACTGCAGAACTGGGATGTGGAGCTGGAAGTGCCTCCTCTTCTGGGCTGTGCTGGTCACAGCCACACTCTGCACCGCTAGGCCGTCCCCGACCTTGCCTGAACAAGGATGGCAGCTGTGACCCGGGATTTCGGTGAGATGCTTCTGCACTCTGGCCGGGTCCTGCCAGCCGAAGCCCAGCCCTGGGGAGCCCCTGTGGAAGTGGAGTCCTTCCTGGTCCACCCCGGTGACCTGCTGCAGCTTCGCTGTCGGCTGCGGGACGATGTGCAGAGCATCAACTGGCTGCGGGACGGGGTGCAGCTGGCGGAAAGCAACCGCACCCGCATCACAGGGGAGGAGGTGGAGGTGCAGGACTCCGTGCCCGCAGACTCCGGCCTCTATGCTTGCGTAACCAGCAGCCCCTCGGGCAGTGACACCACCTACTTCTCCGTCAATGTTTCAGATGCTCTCCCCTCCTCGGAGGATGATGATGATGATGATGACTCCTCTTCAGAGGAGAAAGAAACAGATAACACCAAACCAAACCGTATGCCCGTAGCTCCATATTGGACATCCCCAGAAAAGATGGAAAAGAAATTGCATGCAGTGCCGGCTGCCAAGACAGTGAAGTTCAAATGCCCTTCCAGTGGGACCCCAAACCCCACACTGCGCTGGTTGAAAAATGGCAAAGAATTCAAACCTGACCACAGAATTGGAGGCTACAAGGTCCGTTATGCCACCTGGAGCATCATAATGGACTCTGTGGTGCCCTCTGACAAGGGCAACTACACCTGCATTGTGGAGAATGAGTACGGCAGCATCAACCACACATACCAGCTGGATGTCGTGGAGCGGTCCCCTCACCGGCCCATCCTGCAAGCAGGGTTGCCCGCCAACAAAACAGTGGCCCTGGGTAGCAACGTGGAGTTCATGTGTAAGGTGTACAGTGACCCGCAGCCGCACATCCAGTGGCTAAAGCACATCGAGGTGAATGGGAGCAAGATTGGCCCAGACAACCTGCCTTATGTCCAGATCTTGAAGACTGCTGGAGTTAATACCACCGACAAAGAGATGGAGGTGCTTCACTTAAGAAATGTCTCCTTTGAGGACGCAGGGGAGTATACGTGCTTGGCGGGTAACTCTATCGGACTCTCCCATCACTCTGCATGGTTGACCGTTCTGGAAGCCCTGGAAGAGAGGCCGGCAGTGATGACCTCGCCCCTGTACCTGGAGATCATCATCTATTGCACAGGGGCCTTCCTCATCTCCTGCATGGTGGGGTCGGTCATCGTCTACAAGATGAAGAGTGGTACCAAGAAGAGTGACTTCCACAGCCAGATGGCTGTGCACAAGCTGGCCAAGAGCATCCCTCTGCGCAGACAGGTGTCTGCTGACTCCAGTGCATCCATGAACTCTGGGGTTCTTCTGGTTCGGCCATCACGGCTCTCCTCCAGTGGGACTCCCATGCTAGCAGGGGTCTCTGAGTATGAGCTTCCCGAAGACCCTCGCTGGGAGCTGCCTCGGGACAGACTGGTCTTAGGCAAACCCCTGGGAGAGGGCTGCTTTGGGCAGGTGGTGTTGGCAGAGGCTATCGGGCTGGACAAGGACAAACCCAACCGTGTGACCAAAGTGGCTGTGAAGATGTTGAAGTCGGACGCAACAGAGAAAGACTTGTCAGACCTGATCTCAGAAATGGAGATGATGAAGATGATCGGGAAGCATAAGAATATCATCAACCTGCTGGGGGCCTGCACGCAGGATGGTCCCTTGTATGTCATCGTGGAGTATGCCTCCAAGGGCAACCTGCGGGAGTACCTGCAGGCCCGGAGGCCCCCAGGGCTGGAATACTGCTACAACCCCAGCCACAACCCAGAGGAGCAGCTCTCCTCCAAGGACCTGGTGTCCTGCGCCTACCAGGTGGCCCGAGGCATGGAGTATCTGGCCTCCAAGAAGTGCATACACCGAGACCTGGCAGCCAGGAATGTCCTGGTGACAGAGGACAATGTGATGAAGATAGCAGACTTTGGCCTCGCACGGGACATTCACCACATCGACTACTATAAAAAGACAACCAACGGCCGACTGCCTGTGAAGTGGATGGCACCCGAGGCATTATTTGACCGGATCTACACCCACCAGAGTGATGTGTGGTCTTTCGGGGTGCTCCTGTGGGAGATCTTCACTCTGGGCGGCTCCCCATACCCCGGTGTGCCTGTGGAGGAACTTTTCAAGCTGCTGAAGGAGGGTCACCGCATGGACAAGCCCAGTAACTGCACCAACGAGCTGTACATGATGATGCGGGACTGCTGGCATGCAGTGCCCTCACAGAGACCCACCTTCAAGCAGCTGGTGGAAGACCTGGACCGCATCGTGGCCTTGACCTCCAACCAGGAGTACCTGGACCTGTCCATGCCCCTGGACCAGTACTCCCCCAGCTTTCCCGACACCCGGAGCTCTACGTGCTCCTCAGGGGAGGATTCCGTCTTCTCTCATGAGCCGCTGCCCGAGGAGCCCTGCCTGCCCCGACACCCAGCCCAGCTTGCCAATGGCGGACTCAAACGCCGCTGACTGCCACCCACACGCCCTCCCCAGACTCCACCGTCAGCTGTAACCCTCACCCACAGCCCCTGCTGGGCCCACCACCTGTCCGTCCCTGTCCCCTTTCCTGCTGGCAGGAGCCGGCTGCCTACCAGGGGCCTTCCTGTGTGGCCTGCCTTCACCCCACTCAGCTCACCTCTCCCTCCACCTCCTCTCCACCTGCTGGTGAGAGGTGCAAAGAGGCAGATCTTTGCTGCCAGCCACTTCATCCCCTCCCAGATGTTGGACCAACACCCCTCCCTGCCACCAGGCACTGCCTGGAGGGCAGGGAGTGGGAGCCAATGAACAGGCATGCAAGTGAGAGCTTCCTGAGCTTTCTCCTGTCGGTTTGGTCTGTTTTGCCTTCACCCATAAGCCCCTCGCACTCTGGTGGCAGGTGCCTTGTCCTCAGGGCTACAGCAGTAGGGAGGTCAGTGCTTCGTGCCTCGATTGAAGGTGACCTCTGCCCCAGATAGGTGGTGCCAGTGGCTTATTAATTCCGATACTAGTTTGCTTTGCTGACCAAATGCCTGGTACCAGAGGATGGTGAGGCGAAGGCCAGGTTGGGGGCAGTGTTGTGGCCCTGGGGCCCAGCCCCAAACTGGGGGCTCTGTATATAGCTATGAAGAAAACACAAAGTGTATAAATCTGAGTATATATTTACATGTCTTTTTAAAAGGGTCGTTACCAGAGATTTACCCATCGGGTAAGATGCTCCTGGTGGCTGGGAGGCATCAGTTGCTATATATTAAAAACAAAAAAGAAAAAAAAGGAAAATGTTTTTAAAAAGGTCATATATTTTTTGCTACTTTTGCTGTTTTATTTTTTTAAATTATGTTCTAAACCTATTTTCAGTTTAGGTCCCTCAATAAAAATTGCTGCTGCTTC

SEQ ID NO: 10 - protein, 812 aa, Homo sapiens
MAAVTRDFGEMLLHSGRVLPAEAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 11 - protein, 3824 aa, Homo sapiens
CTTGCGGCCACAGGCGCGGCGTCCTCGGCGGCGGGCGGCAGCTAGCGGGAGCCGGGACGCCGGTGCAGCCGCAGCGCGCGGAGGAACCCGGGTGTGCCGGGAGCTGGGCGGCCACGTCCGGACGGGACCGAGACCCCTCGTAGCGCATTGCGGCGACCTCGCCTTCCCCGGCCGCGAGCGCGCCGCTGCTTGAAAAGCCGCGGAACCCAAGGACTTTTCTCCGGTCCGAGCTCGGGGCGCCCCGCAGGGCGCACGGTACCCGTGCTGCAGTCGGGCACGCCGCGGCGCCGGGGCCTCCGCAGGGCGATGGAGCCCGGTCTGCAAGGAAAGTGAGGCGCCGCCGCTGCGTTCTGGAGGAGGGGGGCACAAGGTCTGGAGACCCCGGGTGGCGGACGGGAGCCCTCCCCCCGCCCCGCCTCCGGGGCACCAGCTCCGGCTCCATTGTTCCCGCCCGGGCTGGAGGCGCCGAGCACCGAGCGCCGCCGGGAGTCGAGCGCCGGCCGCGGAGCTCTTGCGACCCCGCCAGGACCCGAACAGAGCCCGGGGGCGGCGGGCCGGAGCCGGGGACGCGGGCACACGCCCGCTCGCACAAGCCACGGCGGACTCTCCCGAGGCGGAACCTCCACGCCGAGCGAGGGTCAGTTTGAAAAGGAGGATCGAGCTCACTGTGGAGTATCCATGGAGATGTGGAGCCTTGTCACCAACCTCTAACTGCAGAACTGGGATGTGGAGCTGGAAGTGCCTCCTCTTCTGGGCTGTGCTGGTCACAGCCACACTCTGCACCGCTAGGCCGTCCCCGACCTTGCCTGAACAAGATGCTCTCCCCTCCTCGGAGGATGATGATGATGATGATGACTCCTCTTCAGAGGAGAAAGAAACAGATAACACCAAACCAAACCGTATGCCCGTAGCTCCATATTGGACATCCCCAGAAAAGATGGAAAAGAAATTGCATGCAGTGCCGGCTGCCAAGACAGTGAAGTTCAAATGCCCTTCCAGTGGGACCCCAAACCCCACACTGCGCTGGTTGAAAAATGGCAAAGAATTCAAACCTGACCACAGAATTGGAGGCTACAAGGTCCGTTATGCCACCTGGAGCATCATAATGGACTCTGTGGTGCCCTCTGACAAGGGCAACTACACCTGCATTGTGGAGAATGAGTACGGCAGCATCAACCACACATACCAGCTGGATGTCGTGGAGCGGTCCCCTCACCGGCCCATCCTGCAAGCAGGGTTGCCCGCCAACAAAACAGTGGCCCTGGGTAGCAACGTGGAGTTCATGTGTAAGGTGTACAGTGACCCGCAGCCGCACATCCAGTGGCTAAAGCACATCGAGGTGAATGGGAGCAAGATTGGCCCAGACAACCTGCCTTATGTCCAGATCTTGAAGACTGCTGGAGTTAATACCACCGACAAAGAGATGGAGGTGCTTCACTTAAGAAATGTCTCCTTTGAGGACGCAGGGGAGTATACGTGCTTGGCGGGTAACTCTATCGGACTCTCCCATCACTCTGCATGGTTGACCGTTCTGGAAGCCCTGGAAGAGAGGCCGGCAGTGATGACCTCGCCCCTGTACCTGGAGATCATCATCTATTGCACAGGGGCCTTCCTCATCTCCTGCATGGTGGGGTCGGTCATCGTCTACAAGATGAAGAGTGGTACCAAGAAGAGTGACTTCCACAGCCAGATGGCTGTGCACAAGCTGGCCAAGAGCATCCCTCTGCGCAGACAGGTAACAGTGTCTGCTGACTCCAGTGCATCCATGAACTCTGGGGTTCTTCTGGTTCGGCCATCACGGCTCTCCTCCAGTGGGACTCCCATGCTAGCAGGGGTCTCTGAGTATGAGCTTCCCGAAGACCCTCGCTGGGAGCTGCCTCGGGACAGACTGGTCTTAGGCAAACCCCTGGGAGAGGGCTGCTTTGGGCAGGTGGTGTTGGCAGAGGCTATCGGGCTGGACAAGGACAAACCCAACCGTGTGACCAAAGTGGCTGTGAAGATGTTGAAGTCGGACGCAACAGAGAAAGACTTGTCAGACCTGATCTCAGAAATGGAGATGATGAAGATGATCGGGAAGCATAAGAATATCATCAACCTGCTGGGGGCCTGCACGCAGGATGGTCCCTTGTATGTCATCGTGGAGTATGCCTCCAAGGGCAACCTGCGGGAGTACCTGCAGGCCCGGAGGCCCCCAGGGCTGGAATACTGCTACAACCCCAGCCACAACCCAGAGGAGCAGCTCTCCTCCAAGGACCTGGTGTCCTGCGCCTACCAGGTGGCCCGAGGCATGGAGTATCTGGCCTCCAAGAAGTGCATACACCGAGACCTGGCAGCCAGGAATGTCCTGGTGACAGAGGACAATGTGATGAAGATAGCAGACTTTGGCCTCGCACGGGACATTCACCACATCGACTACTATAAAAAGACAACCAACGGCCGACTGCCTGTGAAGTGGATGGCACCCGAGGCATTATTTGACCGGATCTACACCCACCAGAGTGATGTGTGGTCTTTCGGGGTGCTCCTGTGGGAGATCTTCACTCTGGGCGGCTCCCCATACCCCGGTGTGCCTGTGGAGGAACTTTTCAAGCTGCTGAAGGAGGGTCACCGCATGGACAAGCCCAGTAACTGCACCAACGAGCTGTACATGATGATGCGGGACTGCTGGCATGCAGTGCCCTCACAGAGACCCACCTTCAAGCAGCTGGTGGAAGACCTGGACCGCATCGTGGCCTTGACCTCCAACCAGGAGTACCTGGACCTGTCCATGCCCCTGGACCAGTACTCCCCCAGCTTTCCCGACACCCGGAGCTCTACGTGCTCCTCAGGGGAGGATTCCGTCTTCTCTCATGAGCCGCTGCCCGAGGAGCCCTGCCTGCCCCGACACCCAGCCCAGCTTGCCAATGGCGGACTCAAACGCCGCTGACTGCCACCCACACGCCCTCCCCAGACTCCACCGTCAGCTGTAACCCTCACCCACAGCCCCTGCTGGGCCCACCACCTGTCCGTCCCTGTCCCCTTTCCTGCTGGCAGGAGCCGGCTGCCTACCAGGGGCCTTCCTGTGTGGCCTGCCTTCACCCCACTCAGCTCACCTCTCCCTCCACCTCCTCTCCACCTGCTGGTGAGAGGTGCAAAGAGGCAGATCTTTGCTGCCAGCCACTTCATCCCCTCCCAGATGTTGGACCAACACCCCTCCCTGCCACCAGGCACTGCCTGGAGGGCAGGGAGTGGGAGCCAATGAACAGGCATGCAAGTGAGAGCTTCCTGAGCTTTCTCCTGTCGGTTTGGTCTGTTTTGCCTTCACCCATAAGCCCCTCGCACTCTGGTGGCAGGTGCCTTGTCCTCAGGGCTACAGCAGTAGGGAGGTCAGTGCTTCGTGCCTCGATTGAAGGTGACCTCTGCCCCAGATAGGTGGTGCCAGTGGCTTATTAATTCCGATACTAGTTTGCTTTGCTGACCAAATGCCTGGTACCAGAGGATGGTGAGGCGAAGGCCAGGTTGGGGGCAGTGTTGTGGCCCTGGGGCCCAGCCCCAAACTGGGGGCTCTGTATATAGCTATGAAGAAAACACAAAGTGTATAAATCTGAGTATATATTTACATGTCTTTTTAAAAGGGTCGTTACCAGAGATTTACCCATCGGGTAAGATGCTCCTGGTGGCTGGGAGGCATCAGTTGCTATATATTAAAAACAAAAAAGAAAAAAAAGGAAAATGTTTTTAAAAAGGTCATATATTTTTTGCTACTTTTGCTGTTTTATTTTTTTAAATTATGTTCTAAACCTATTTTCAGTTTAGGTCCCTCAATAAAAATTGCTGCTGCTTCA

SEQ ID NO: 12 - protein, 733 aa, Homo sapiens
MWSWKCLLFWAVLVTATLCTARPSPTLPEQDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 13 - protein, 3816 aa, Homo sapiens
CTTGCGGCCACAGGCGCGGCGTCCTCGGCGGCGGGCGGCAGCTAGCGGGAGCCGGGACGCCGGTGCAGCCGCAGCGCGCGGAGGAACCCGGGTGTGCCGGGAGCTGGGCGGCCACGTCCGGACGGGACCGAGACCCCTCGTAGCGCATTGCGGCGACCTCGCCTTCCCCGGCCGCGAGCGCGCCGCTGCTTGAAAAGCCGCGGAACCCAAGGACTTTTCTCCGGTCCGAGCTCGGGGCGCCCCGCAGGGCGCACGGTACCCGTGCTGCAGTCGGGCACGCCGCGGCGCCGGGGCCTCCGCAGGGCGATGGAGCCCGGTCTGCAAGGAAAGTGAGGCGCCGCCGCTGCGTTCTGGAGGAGGGGGGCACAAGGTCTGGAGACCCCGGGTGGCGGACGGGAGCCCTCCCCCCGCCCCGCCTCCGGGGCACCAGCTCCGGCTCCATTGTTCCCGCCCGGGCTGGAGGCGCCGAGCACCGAGCGCCGCCGGGAGTCGAGCGCCGGCCGCGGAGCTCTTGCGACCCCGCCAGGACCCGAACAGAGCCCGGGGGCGGCGGGCCGGAGCCGGGGACGCGGGCACACGCCCGCTCGCACAAGCCACGGCGGACTCTCCCGAGGCGGAACCTCCACGCCGAGCGAGGGTCAGTTTGAAAAGGAGGATCGAGCTCACTGTGGAGTATCCATGGAGATGTGGAGCCTTGTCACCAACCTCTAACTGCAGAACTGGGATGTGGAGCTGGAAGTGCCTCCTCTTCTGGGCTGTGCTGGTCACAGCCACACTCTGCACCGCTAGGCCGTCCCCGACCTTGCCTGAACAAGATGCTCTCCCCTCCTCGGAGGATGATGATGATGATGATGACTCCTCTTCAGAGGAGAAAGAAACAGATAACACCAAACCAAACCCCGTAGCTCCATATTGGACATCCCCAGAAAAGATGGAAAAGAAATTGCATGCAGTGCCGGCTGCCAAGACAGTGAAGTTCAAATGCCCTTCCAGTGGGACCCCAAACCCCACACTGCGCTGGTTGAAAAATGGCAAAGAATTCAAACCTGACCACAGAATTGGAGGCTACAAGGTCCGTTATGCCACCTGGAGCATCATAATGGACTCTGTGGTGCCCTCTGACAAGGGCAACTACACCTGCATTGTGGAGAATGAGTACGGCAGCATCAACCACACATACCAGCTGGATGTCGTGGAGCGGTCCCCTCACCGGCCCATCCTGCAAGCAGGGTTGCCCGCCAACAAAACAGTGGCCCTGGGTAGCAACGTGGAGTTCATGTGTAAGGTGTACAGTGACCCGCAGCCGCACATCCAGTGGCTAAAGCACATCGAGGTGAATGGGAGCAAGATTGGCCCAGACAACCTGCCTTATGTCCAGATCTTGAAGACTGCTGGAGTTAATACCACCGACAAAGAGATGGAGGTGCTTCACTTAAGAAATGTCTCCTTTGAGGACGCAGGGGAGTATACGTGCTTGGCGGGTAACTCTATCGGACTCTCCCATCACTCTGCATGGTTGACCGTTCTGGAAGCCCTGGAAGAGAGGCCGGCAGTGATGACCTCGCCCCTGTACCTGGAGATCATCATCTATTGCACAGGGGCCTTCCTCATCTCCTGCATGGTGGGGTCGGTCATCGTCTACAAGATGAAGAGTGGTACCAAGAAGAGTGACTTCCACAGCCAGATGGCTGTGCACAAGCTGGCCAAGAGCATCCCTCTGCGCAGACAGGTAACAGTGTCTGCTGACTCCAGTGCATCCATGAACTCTGGGGTTCTTCTGGTTCGGCCATCACGGCTCTCCTCCAGTGGGACTCCCATGCTAGCAGGGGTCTCTGAGTATGAGCTTCCCGAAGACCCTCGCTGGGAGCTGCCTCGGGACAGACTGGTCTTAGGCAAACCCCTGGGAGAGGGCTGCTTTGGGCAGGTGGTGTTGGCAGAGGCTATCGGGCTGGACAAGGACAAACCCAACCGTGTGACCAAAGTGGCTGTGAAGATGTTGAAGTCGGACGCAACAGAGAAAGACTTGTCAGACCTGATCTCAGAAATGGAGATGATGAAGATGATCGGGAAGCATAAGAATATCATCAACCTGCTGGGGGCCTGCACGCAGGATGGTCCCTTGTATGTCATCGTGGAGTATGCCTCCAAGGGCAACCTGCGGGAGTACCTGCAGGCCCGGAGGCCCCCAGGGCTGGAATACTGCTACAACCCCAGCCACAACCCAGAGGAGCAGCTCTCCTCCAAGGACCTGGTGTCCTGCGCCTACCAGGTGGCCCGAGGCATGGAGTATCTGGCCTCCAAGAAGTGCATACACCGAGACCTGGCAGCCAGGAATGTCCTGGTGACAGAGGACAATGTGATGAAGATAGCAGACTTTGGCCTCGCACGGGACATTCACCACATCGACTACTATAAAAAGACAACCAACGGCCGACTGCCTGTGAAGTGGATGGCACCCGAGGCATTATTTGACCGGATCTACACCCACCAGAGTGATGTGTGGTCTTTCGGGGTGCTCCTGTGGGAGATCTTCACTCTGGGCGGCTCCCCATACCCCGGTGTGCCTGTGGAGGAACTTTTCAAGCTGCTGAAGGAGGGTCACCGCATGGACAAGCCCAGTAACTGCACCAACGAGCTGTACATGATGATGCGGGACTGCTGGCATGCAGTGCCCTCACAGAGACCCACCTTCAAGCAGCTGGTGGAAGACCTGGACCGCATCGTGGCCTTGACCTCCAACCAGGAGTACCTGGACCTGTCCATGCCCCTGGACCAGTACTCCCCCAGCTTTCCCGACACCCGGAGCTCTACGTGCTCCTCAGGGGAGGATTCCGTCTTCTCTCATGAGCCGCTGCCCGAGGAGCCCTGCCTGCCCCGACACCCAGCCCAGCTTGCCAATGGCGGACTCAAACGCCGCTGACTGCCACCCACACGCCCTCCCCAGACTCCACCGTCAGCTGTAACCCTCACCCACAGCCCCTGCTGGGCCCACCACCTGTCCGTCCCTGTCCCCTTTCCTGCTGGCAGGAGCCGGCTGCCTACCAGGGGCCTTCCTGTGTGGCCTGCCTTCACCCCACTCAGCTCACCTCTCCCTCCACCTCCTCTCCACCTGCTGGTGAGAGGTGCAAAGAGGCAGATCTTTGCTGCCAGCCACTTCATCCCCTCCCAGATGTTGGACCAACACCCCTCCCTGCCACCAGGCACTGCCTGGAGGGCAGGGAGTGGGAGCCAATGAACAGGCATGCAAGTGAGAGCTTCCTGAGCTTTCTCCTGTCGGTTTGGTCTGTTTTGCCTTCACCCATAAGCCCCTCGCACTCTGGTGGCAGGTGCCTTGTCCTCAGGGCTACAGCAGTAGGGAGGTCAGTGCTTCGTGCCTCGATTGAAGGTGACCTCTGCCCCAGATAGGTGGTGCCAGTGGCTTATTAATTCCGATACTAGTTTGCTTTGCTGACCAAATGCCTGGTACCAGAGGATGGTGAGGCGAAGGCCAGGTTGGGGGCAGTGTTGTGGCCCTGGGGCCCAGCCCCAAACTGGGGGCTCTGTATATAGCTATGAAGAAAACACAAAGTGTATAAATCTGAGTATATATTTACATGTCTTTTTAAAAGGGTCGTTACCAGAGATTTACCCATCGGGTAAGATGCTCCTGGTGGCTGGGAGGCATCAGTTGCTATATATTAAAAACAAAAAAGAAAAAAAAGGAAAATGTTTTTAAAAAGGTCATATATTTTTTGCTACTTTTGCTGTTTTATTTTTTTAAATTATGTTCTAAACCTATTTTCAGTTTAGGTCCCTCAATAAAAATTGCTGCTGCTT

SEQ ID NO: 14 - protein, 731 aa, Homo sapiens
MWSWKCLLFWAVLVTATLCTARPSPTLPEQDALPSSEDDDDDDDSSSEEKETDNTKPNPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTVSADSSASMNSGVLLVRPSRLSSSGTPMLAGVSEYELPEDPRWELPRDRLVLGKPLGEGCFGQVVLAEAIGLDKDKPNRVTKVAVKMLKSDATEKDLSDLISEMEMMKMIGKHKNIINLLGACTQDGPLYVIVEYASKGNLREYLQARRPPGLEYCYNPSHNPEEQLSSKDLVSCAYQVARGMEYLASKKCIHRDLAARNVLVTEDNVMKIADFGLARDIHHIDYYKKTTNGRLPVKWMAPEALFDRIYTHQSDVWSFGVLLWEIFTLGGSPYPGVPVEELFKLLKEGHRMDKPSNCTNELYMMMRDCWHAVPSQRPTFKQLVEDLDRIVALTSNQEYLDLSMPLDQYSPSFPDTRSSTCSSGEDSVFSHEPLPEEPCLPRHPAQLANGGLKRR

SEQ ID NO: 15 - protein, 3680 aa, Homo sapiens
GCTTTGCCCGCCGCAGCCCAGCCGGGGCCGGCGCCTCCCTCCGCTCGCCGCCCGCCCCTTTCACCTCCTGGCTCCCTCCCGGGCGATCCGCGCCCCTTGGGTCTCCCCTCCCTTCCCTCCGTCCGCGTCTCCTGCGCCCCCTCCCTGCGCTCGTCCCGCCGCTCTTCCCGCCGCCCAACTTTTCCTCCAACTCGCGCTCGGGAGCTGGCGAGGCGGCGGCGGCTCCTCAGGTCAGTTTGAAAAGGAGGATCGAGCTCACTGTGGAGTATCCATGGAGATGTGGAGCCTTGTCACCAACCTCTAACTGCAGAACTGGGATGTGGAGCTGGAAGTGCCTCCTCTTCTGGGCTGTGCTGGTCACAGCCACACTCTGCACCGCTAGGCCGTCCCCGACCTTGCCTGAACAAGCCCAGCCCTGGGGAGCCCCTGTGGAAGTGGAGTCCTTCCTGGTCCACCCCGGTGACCTGCTGCAGCTTCGCTGTCGGCTGCGGGACGATGTGCAGAGCATCAACTGGCTGCGGGACGGGGTGCAGCTGGCGGAAAGCAACCGCACCCGCATCACAGGGGAGGAGGTGGAGGTGCAGGACTCCGTGCCCGCAGACTCCGGCCTCTATGCTTGCGTAACCAGCAGCCCCTCGGGCAGTGACACCACCTACTTCTCCGTCAATGTTTCAGATGCTCTCCCCTCCTCGGAGGATGATGATGATGATGATGACTCCTCTTCAGAGGAGAAAGAAACAGATAACACCAAACCAAACCCCGTAGCTCCATATTGGACATCCCCAGAAAAGATGGAAAAGAAATTGCATGCAGTGCCGGCTGCCAAGACAGTGAAGTTCAAATGCCCTTCCAGTGGGACCCCAAACCCCACACTGCGCTGGTTGAAAAATGGCAAAGAATTCAAACCTGACCACAGAATTGGAGGCTACAAGGTCCGTTATGCCACCTGGAGCATCATAATGGACTCTGTGGTGCCCTCTGACAAGGGCAACTACACCTGCATTGTGGAGAATGAGTACGGCAGCATCAACCACACATACCAGCTGGATGTCGTGGAGCGGTCCCCTCACCGGCCCATCCTGCAAGCAGGGTTGCCCGCCAACAAAACAGTGGCCCTGGGTAGCAACGTGGAGTTCATGTGTAAGGTGTACAGTGACCCGCAGCCGCACATCCAGTGGCTAAAGCACATCGAGGTGAATGGGAGCAAGATTGGCCCAGACAACCTGCCTTATGTCCAGATCTTGAAGACTGCTGGAGTTAATACCACCGACAAAGAGATGGAGGTGCTTCACTTAAGAAATGTCTCCTTTGAGGACGCAGGGGAGTATACGTGCTTGGCGGGTAACTCTATCGGACTCTCCCATCACTCTGCATGGTTGACCGTTCTGGAAGCCCTGGAAGAGAGGCCGGCAGTGATGACCTCGCCCCTGTACCTGGAGATCATCATCTATTGCACAGGGGCCTTCCTCATCTCCTGCATGGTGGGGTCGGTCATCGTCTACAAGATGAAGAGTGGTACCAAGAAGAGTGACTTCCACAGCCAGATGGCTGTGCACAAGCTGGCCAAGAGCATCCCTCTGCGCAGACAGGTAACAGTGTCTGCTGACTCCAGTGCATCCATGAACTCTGGGGTTCTTCTGGTTCGGCCATCACGGCTCTCCTCCAGTGGGACTCCCATGCTAGCAGGGGTCTCTGAGTATGAGCTTCCCGAAGACCCTCGCTGGGAGCTGCCTCGGGACAGACTGGTCTTAGGCAAACCCCTGGGAGAGGGCTGCTTTGGGCAGGTGGTGTTGGCAGAGGCTATCGGGCTGGACAAGGACAAACCCAACCGTGTGACCAAAGTGGCTGTGAAGATGTTGAAGTCGGACGCAACAGAGAAAGACTTGTCAGACCTGATCTCAGAAATGGAGATGATGAAGATGATCGGGAAGCATAAGAATATCATCAACCTGCTGGGGGCCTGCACGCAGGATGGTCCCTTGTATGTCATCGTGGAGTATGCCTCCAAGGGCAACCTGCGGGAGTACCTGCAGGCCCGGAGGCCCCCAGGGCTGGAATACTGCTACAACCCCAGCCACAACCCAGAGGAGCAGCTCTCCTCCAAGGACCTGGTGTCCTGCGCCTACCAGGTGGCCCGAGGCATGGAGTATCTGGCCTCCAAGAAGTGCATACACCGAGACCTGGCAGCCAGGAATGTCCTGGTGACAGAGGACAATGTGATGAAGATAGCAGACTTTGGCCTCGCACGGGACATTCACCACATCGACTACTATAAAAAGACAACCAACGGCCGACTGCCTGTGAAGTGGATGGCACCCGAGGCATTATTTGACCGGATCTACACCCACCAGAGTGATGTGTGGTCTTTCGGGGTGCTCCTGTGGGAGATCTTCACTCTGGGCGGCTCCCCATACCCCGGTGTGCCTGTGGAGGAACTTTTCAAGCTGCTGAAGGAGGGTCACCGCATGGACAAGCCCAGTAACTGCACCAACGAGCTGTACATGATGATGCGGGACTGCTGGCATGCAGTGCCCTCACAGAGACCCACCTTCAAGCAGCTGGTGGAAGACCTGGACCGCATCGTGGCCTTGACCTCCAACCAGGAGTACCTGGACCTGTCCATGCCCCTGGACCAGTACTCCCCCAGCTTTCCCGACACCCGGAGCTCTACGTGCTCCTCAGGGGAGGATTCCGTCTTCTCTCATGAGCCGCTGCCCGAGGAGCCCTGCCTGCCCCGACACCCAGCCCAGCTTGCCAATGGCGGACTCAAACGCCGCTGACTGCCACCCACACGCCCTCCCCAGACTCCACCGTCAGCTGTAACCCTCACCCACAGCCCCTGCTGGGCCCACCACCTGTCCGTCCCTGTCCCCTTTCCTGCTGGCAGGAGCCGGCTGCCTACCAGGGGCCTTCCTGTGTGGCCTGCCTTCACCCCACTCAGCTCACCTCTCCCTCCACCTCCTCTCCACCTGCTGGTGAGAGGTGCAAAGAGGCAGATCTTTGCTGCCAGCCACTTCATCCCCTCCCAGATGTTGGACCAACACCCCTCCCTGCCACCAGGCACTGCCTGGAGGGCAGGGAGTGGGAGCCAATGAACAGGCATGCAAGTGAGAGCTTCCTGAGCTTTCTCCTGTCGGTTTGGTCTGTTTTGCCTTCACCCATAAGCCCCTCGCACTCTGGTGGCAGGTGCCTTGTCCTCAGGGCTACAGCAGTAGGGAGGTCAGTGCTTCGTGCCTCGATTGAAGGTGACCTCTGCCCCAGATAGGTGGTGCCAGTGGCTTATTAATTCCGATACTAGTTTGCTTTGCTGACCAAATGCCTGGTACCAGAGGATGGTGAGGCGAAGGCCAGGTTGGGGGCAGTGTTGTGGCCCTGGGGCCCAGCCCCAAACTGGGGGCTCTGTATATAGCTATGAAGAAAACACAAAGTGTATAAATCTGAGTATATATTTACATGTCTTTTTAAAAGGGTCGTTACCAGAGATTTACCCATCGGGTAAGATGCTCCTGGTGGCTGGGAGGCATCAGTTGCTATATATTAAAAACAAAAAAGAAAAAAAAGGAAAATGTTTTTAAAAAGGTCATATATTTTTTGCTACTTTTGCTGTTTTATTTTTTTAAATTATGTTCTAAACCTATTTTCAGTTTAGGTCCCTCAATAAAAATTGCTGCTGCTTCATT

SEQ ID NO: 16 - protein, 820 aa, Homo sapiens; identical to SEQ ID NO: 4

SEQ ID NO: 17 - protein, 2870 aa, Homo sapiens
AACTTTTCCTCCAACTCGCGCTCGGGAGCTGGCGAGGCGGCGGCGGCTCCTCAAAGTGGGAGAGCTTCAAGGTCACGTGGTCCGTCCAGCCCCTGCTATCTCACCAGACACTGTCCACCCTGTATGTTGGATCAGTACTCCAGTGAGAAGACAGCAGGCACTTTCACCCATGCAGCCCATTCAGTCTTCATAACCACCTGTGATGGAGGCAAGGGTCAGTTTGAAAAGGAGGATCGAGCTCACTGTGGAGTATCCATGGAGATGTGGAGCCTTGTCACCAACCTCTAACTGCAGAACTGGGATGTGGAGCTGGAAGTGCCTCCTCTTCTGGGCTGTGCTGGTCACAGCCACACTCTGCACCGCTAGGCCGTCCCCGACCTTGCCTGAACAAGCCCAGCCCTGGGGAGCCCCTGTGGAAGTGGAGTCCTTCCTGGTCCACCCCGGTGACCTGCTGCAGCTTCGCTGTCGGCTGCGGGACGATGTGCAGAGCATCAACTGGCTGCGGGACGGGGTGCAGCTGGCGGAAAGCAACCGCACCCGCATCACAGGGGAGGAGGTGGAGGTGCAGGACTCCGTGCCCGCAGACTCCGGCCTCTATGCTTGCGTAACCAGCAGCCCCTCGGGCAGTGACACCACCTACTTCTCCGTCAATGTTTCAGATGCTCTCCCCTCCTCGGAGGATGATGATGATGATGATGACTCCTCTTCAGAGGAGAAAGAAACAGATAACACCAAACCAAACCCCGTAGCTCCATATTGGACATCCCCAGAAAAGATGGAAAAGAAATTGCATGCAGTGCCGGCTGCCAAGACAGTGAAGTTCAAATGCCCTTCCAGTGGGACCCCAAACCCCACACTGCGCTGGTTGAAAAATGGCAAAGAATTCAAACCTGACCACAGAATTGGAGGCTACAAGGTCCGTTATGCCACCTGGAGCATCATAATGGACTCTGTGGTGCCCTCTGACAAGGGCAACTACACCTGCATTGTGGAGAATGAGTACGGCAGCATCAACCACACATACCAGCTGGATGTCGTGGAGCGGTCCCCTCACCGGCCCATCCTGCAAGCAGGGTTGCCCGCCAACAAAACAGTGGCCCTGGGTAGCAACGTGGAGTTCATGTGTAAGGTGTACAGTGACCCGCAGCCGCACATCCAGTGGCTAAAGCACATCGAGGTGAATGGGAGCAAGATTGGCCCAGACAACCTGCCTTATGTCCAGATCTTGAAGACTGCTGGAGTTAATACCACCGACAAAGAGATGGAGGTGCTTCACTTAAGAAATGTCTCCTTTGAGGACGCAGGGGAGTATACGTGCTTGGCGGGTAACTCTATCGGACTCTCCCATCACTCTGCATGGTTGACCGTTCTGGAAGCCCTGGAAGAGAGGCCGGCAGTGATGACCTCGCCCCTGTACCTGGAGATCATCATCTATTGCACAGGGGCCTTCCTCATCTCCTGCATGGTGGGGTCGGTCATCGTCTACAAGATGAAGAGTGGTACCAAGAAGAGTGACTTCCACAGCCAGATGGCTGTGCACAAGCTGGCCAAGAGCATCCCTCTGCGCAGACAGGTAACAGTGTCTGCTGACTCCAGTGCATCCATGAACTCTGGGGTTCTTCTGGTTCGGCCATCACGGCTCTCCTCCAGTGGGACTCCCATGCTAGCAGGGGTCTCTGAGTATGAGCTTCCCGAAGACCCTCGCTGGGAGCTGCCTCGGGACAGACTGGTCTTAGGCAAACCCCTGGGAGAGGGCTGCTTTGGGCAGGTGGTGTTGGCAGAGGCTATCGGGCTGGACAAGGACAAACCCAACCGTGTGACCAAAGTGGCTGTGAAGATGTTGAAGTCGGACGCAACAGAGAAAGACTTGTCAGACCTGATCTCAGAAATGGAGATGATGAAGATGATCGGGAAGCATAAGAATATCATCAACCTGCTGGGGGCCTGCACGCAGGATGGTCCCTTGTATGTCATCGTGGAGTATGCCTCCAAGGGCAACCTGCGGGAGTACCTGCAGGCCCGGAGGCCCCCAGGGCTGGAATACTGCTACAACCCCAGCCACAACCCAGAGGAGCAGCTCTCCTCCAAGGACCTGGTGTCCTGCGCCTACCAGGTGGCCCGAGGCATGGAGTATCTGGCCTCCAAGAAGTGCATACACCGAGACCTGGCAGCCAGGAATGTCCTGGTGACAGAGGACAATGTGATGAAGATAGCAGACTTTGGCCTCGCACGGGACATTCACCACATCGACTACTATAAAAAGACAACCAACGGCCGACTGCCTGTGAAGTGGATGGCACCCGAGGCATTATTTGACCGGATCTACACCCACCAGAGTGATGTGTGGTCTTTCGGGGTGCTCCTGTGGGAGATCTTCACTCTGGGCGGCTCCCCATACCCCGGTGTGCCTGTGGAGGAACTTTTCAAGCTGCTGAAGGAGGGTCACCGCATGGACAAGCCCAGTAACTGCACCAACGAGCTGTACATGATGATGCGGGACTGCTGGCATGCAGTGCCCTCACAGAGACCCACCTTCAAGCAGCTGGTGGAAGACCTGGACCGCATCGTGGCCTTGACCTCCAACCAGGAGTACCTGGACCTGTCCATGCCCCTGGACCAGTACTCCCCCAGCTTTCCCGACACCCGGAGCTCTACGTGCTCCTCAGGGGAGGATTCCGTCTTCTCTCATGAGCCGCTGCCCGAGGAGCCCTGCCTGCCCCGACACCCAGCCCAGCTTGCCAATGGCGGACTCAAACGCCGCTGACTGCCACCCACACGCCCTCCCCAGACTCCACCGTCAGCTGTAACCCTCACCCACAGCCCCTGCTGGGCCCACCACCTGTCCGTCCCTGTCCCCTTTCCTGCTGGCA

SEQ ID NO: 18 - protein, 820 aa, Homo sapiens; identical to SEQ ID NO: 4

SEQ ID NO: 19 - protein, 4369 aa, Homo sapiens
GGCGGCGGCTGGAGGAGAGCGCGGTGGAGAGCCGAGCGGGCGGGCGGCGGGTGCGGAGCGGGCGAGGGAGCGCGCGCGGCCGCCACAAAGCTCGGGCGCCGCGGGGCTGCATGCGGCGTACCTGGCCCGGCGCGGCGACTGCTCTCCGGGCTGGCGGGGGCCGGCCGCGAGCCCCGGGGGCCCCGAGGCCGCAGCTTGCCTGCGCGCTCTGAGCCTTCGCAACTCGCGAGCAAAGTTTGGTGGAGGCAACGCCAAGCCTGAGTCCTTTCTTCCTCTCGTTCCCCAAATCCGAGGGCAGCCCGCGGGCGTCATGCCCGCGCTCCTCCGCAGCCTGGGGTACGCGTGAAGCCCGGGAGGCTTGGCGCCGGCGAAGACCCAAGGACCACTCTTCTGCGTTTGGAGTTGCTCCCCGCAACCCCGGGCTCGTCGCTTTCTCCATCCCGACCCACGCGGGGCGCGGGGACAACACAGGTCGCGGAGGAGCGTTGCCATTCAAGTGACTGCAGCAGCAGCGGCAGCGCCTCGGTTCCTGAGCCCACCGCAGGCTGAAGGCATTGCGCGTAGTCCATGCCCGTAGAGGAAGTGTGCAGATGGGATTAACGTCCACATGGAGATATGGAAGAGGACCGGGGATTGGTACCGTAACCATGGTCAGCTGGGGTCGTTTCATCTGCCTGGTCGTGGTCACCATGGCAACCTTGTCCCTGGCCCGGCCCTCCTTCAGTTTAGTTGAGGATACCACATTAGAGCCAGAAGATGCCATCTCATCCGGAGATGATGAGGATGACACCGATGGTGCGGAAGATTTTGTCAGTGAGAACAGTAACAACAAGAGAGCACCATACTGGACCAACACAGAAAAGATGGAAAAGCGGCTCCATGCTGTGCCTGCGGCCAACACTGTCAAGTTTCGCTGCCCAGCCGGGGGGAACCCAATGCCAACCATGCGGTGGCTGAAAAACGGGAAGGAGTTTAAGCAGGAGCATCGCATTGGAGGCTACAAGGTACGAAACCAGCACTGGAGCCTCATTATGGAAAGTGTGGTCCCATCTGACAAGGGAAATTATACCTGTGTAGTGGAGAATGAATACGGGTCCATCAATCACACGTACCACCTGGATGTTGTGGAGCGATCGCCTCACCGGCCCATCCTCCAAGCCGGACTGCCGGCAAATGCCTCCACAGTGGTCGGAGGAGACGTAGAGTTTGTCTGCAAGGTTTACAGTGATGCCCAGCCCCACATCCAGTGGATCAAGCACGTGGAAAAGAACGGCAGTAAATACGGGCCCGACGGGCTGCCCTACCTCAAGGTTCTCAAGGCCGCCGGTGTTAACACCACGGACAAAGAGATTGAGGTTCTCTATATTCGGAATGTAACTTTTGAGGACGCTGGGGAATATACGTGCTTGGCGGGTAATTCTATTGGGATATCCTTTCACTCTGCATGGTTGACAGTTCTGCCAGCGCCTGGAAGAGAAAAGGAGATTACAGCTTCCCCAGACTACCTGGAGATAGCCATTTACTGCATAGGGGTCTTCTTAATCGCCTGTATGGTGGTAACAGTCATCCTGTGCCGAATGAAGAACACGACCAAGAAGCCAGACTTCAGCAGCCAGCCGGCTGTGCACAAGCTGACCAAACGTATCCCCCTGCGGAGACAGGTAACAGTTTCGGCTGAGTCCAGCTCCTCCATGAACTCCAACACCCCGCTGGTGAGGATAACAACACGCCTCTCTTCAACGGCAGACACCCCCATGCTGGCAGGGGTCTCCGAGTATGAACTTCCAGAGGACCCAAAATGGGAGTTTCCAAGAGATAAGCTGACACTGGGCAAGCCCCTGGGAGAAGGTTGCTTTGGGCAAGTGGTCATGGCGGAAGCAGTGGGAATTGACAAAGACAAGCCCAAGGAGGCGGTCACCGTGGCCGTGAAGATGTTGAAAGATGATGCCACAGAGAAAGACCTTTCTGATCTGGTGTCAGAGATGGAGATGATGAAGATGATTGGGAAACACAAGAATATCATAAATCTTCTTGGAGCCTGCACACAGGATGGGCCTCTCTATGTCATAGTTGAGTATGCCTCTAAAGGCAACCTCCGAGAATACCTCCGAGCCCGGAGGCCACCCGGGATGGAGTACTCCTATGACATTAACCGTGTTCCTGAGGAGCAGATGACCTTCAAGGACTTGGTGTCATGCACCTACCAGCTGGCCAGAGGCATGGAGTACTTGGCTTCCCAAAAATGTATTCATCGAGATTTAGCAGCCAGAAATGTTTTGGTAACAGAAAACAATGTGATGAAAATAGCAGACTTTGGACTCGCCAGAGATATCAACAATATAGACTATTACAAAAAGACCACCAATGGGCGGCTTCCAGTCAAGTGGATGGCTCCAGAAGCCCTGTTTGATAGAGTATACACTCATCAGAGTGATGTCTGGTCCTTCGGGGTGTTAATGTGGGAGATCTTCACTTTAGGGGGCTCGCCCTACCCAGGGATTCCCGTGGAGGAACTTTTTAAGCTGCTGAAGGAAGGACACAGAATGGATAAGCCAGCCAACTGCACCAACGAACTGTACATGATGATGAGGGACTGTTGGCATGCAGTGCCCTCCCAGAGACCAACGTTCAAGCAGTTGGTAGAAGACTTGGATCGAATTCTCACTCTCACAACCAATGAGGAATACTTGGACCTCAGCCAACCTCTCGAACAGTATTCACCTAGTTACCCTGACACAAGAAGTTCTTGTTCTTCAGGAGATGATTCTGTTTTTTCTCCAGACCCCATGCCTTACGAACCATGCCTTCCTCAGTATCCACACATAAACGGCAGTGTTAAAACATGAATGACTGTGTCTGCCTGTCCCCAAACAGGACAGCACTGGGAACCTAGCTACACTGAGCAGGGAGACCATGCCTCCCAGAGCTTGTTGTCTCCACTTGTATATATGGATCAGAGGAGTAAATAATTGGAAAAGTAATCAGCATATGTGTAAAGATTTATACAGTTGAAAACTTGTAATCTTCCCCAGGAGGAGAAGAAGGTTTCTGGAGCAGTGGACTGCCACAAGCCACCATGTAACCCCTCTCACCTGCCGTGCGTACTGGCTGTGGACCAGTAGGACTCAAGGTGGACGTGCGTTCTGCCTTCCTTGTTAATTTTGTAATAATTGGAGAAGATTTATGTCAGCACACACTTACAGAGCACAAATGCAGTATATAGGTGCTGGATGTATGTAAATATATTCAAATTATGTATAAATATATATTATATATTTACAAGGAGTTATTTTTTGTATTGATTTTAAATGGATGTCCCAATGCACCTAGAAAATTGGTCTCTCTTTTTTTAATAGCTATTTGCTAAATGCTGTTCTTACACATAATTTCTTAATTTTCACCGAGCAGAGGTGGAAAAATACTTTTGCTTTCAGGGAAAATGGTATAACGTTAATTTATTAATAAATTGGTAATATACAAAACAATTAATCATTTATAGTTTTTTTTGTAATTTAAGTGGCATTTCTATGCAGGCAGCACAGCAGACTAGTTAATCTATTGCTTGGACTTAACTAGTTATCAGATCCTTTGAAAAGAGAATATTTACAATATATGACTAATTTGGGGAAAATGAAGTTTTGATTTATTTGTGTTTAAATGCTGCTGTCAGACGATTGTTCTTAGACCTCCTAAATGCCCCATATTAAAAGAACTCATTCATAGGAAGGTGTTTCATTTTGGTGTGCAACCCTGTCATTACGTCAACGCAACGTCTAACTGGACTTCCCAAGATAAATGGTACCAGCGTCCTCTTAAAAGATGCCTTAATCCATTCCTTGAGGACAGACCTTAGTTGAAATGATAGCAGAATGTGCTTCTCTCTGGCAGCTGGCCTTCTGCTTCTGAGTTGCACATTAATCAGATTAGCCTGTATTCTCTTCAGTGAATTTTGATAATGGCTTCCAGACTCTTTGGCGTTGGAGACGCCTGTTAGGATCTTCAAGTCCCATCATAGAAAATTGAAACACAGAGTTGTTCTGCTGATAGTTTTGGGGATACGTCCATCTTTTTAAGGGATTGCTTTCATCTAATTCTGGCAGGACCTCACCAAAAGATCCAGCCTCATACCTACATCAGACAAAATATCGCCGTTGTTCCTTCTGTACTAAAGTATTGTGTTTTGCTTTGGAAACACCCACTCACTTTGCAATAGCCGTGCAAGATGAATGCAGATTACACTGATCTTATGTGTTACAAAATTGGAGAAAGTATTTAATAAAACCTGTTAATTTTTATACTGACAATAAAAATGTTTCTACAGATATTAATGTTAACAAGACAAAATAAATGTCACGCAACTTATTTTTTT

SEQ ID NO: 20 - protein, 732 aa, Homo sapiens
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 21 - protein, 4255 aa, Homo sapiens
CCCAAGGACCACTCTTCTGCGTTTGGAGTTGCTCCCCGCAACCCCGGGCTCGTCGCTTTCTCCATCCCGACCCACGCGGGGCGCGGGGACAACACAGGTCGCGGAGGAGCGTTGCCATTCAAGTGACTGCAGCAGCAGCGGCAGCGCCTCGGTTCCTGAGCCCACCGCAGGCTGAAGGCATTGCGCGTAGTCCATGCCCGTAGAGGAAGTGTGCAGATGGGATTAACGTCCACATGGAGATATGGAAGAGGACCGGGGATTGGTACCGTAACCATGGTCAGCTGGGGTCGTTTCATCTGCCTGGTCGTGGTCACCATGGCAACCTTGTCCCTGGCCCGGCCCTCCTTCAGTTTAGTTGAGGATACCACATTAGAGCCAGAAGAGCCACCAACCAAATACCAAATCTCTCAACCAGAAGTGTACGTGGCTGCGCCAGGGGAGTCGCTAGAGGTGCGCTGCCTGTTGAAAGATGCCGCCGTGATCAGTTGGACTAAGGATGGGGTGCACTTGGGGCCCAACAATAGGACAGTGCTTATTGGGGAGTACTTGCAGATAAAGGGCGCCACGCCTAGAGACTCCGGCCTCTATGCTTGTACTGCCAGTAGGACTGTAGACAGTGAAACTTGGTACTTCATGGTGAATGTCACAGATGCCATCTCATCCGGAGATGATGAGGATGACACCGATGGTGCGGAAGATTTTGTCAGTGAGAACAGTAACAACAAGAGAGCACCATACTGGACCAACACAGAAAAGATGGAAAAGCGGCTCCATGCTGTGCCTGCGGCCAACACTGTCAAGTTTCGCTGCCCAGCCGGGGGGAACCCAATGCCAACCATGCGGTGGCTGAAAAACGGGAAGGAGTTTAAGCAGGAGCATCGCATTGGAGGCTACAAGGTACGAAACCAGCACTGGAGCCTCATTATGGAAAGTGTGGTCCCATCTGACAAGGGAAATTATACCTGTGTAGTGGAGAATGAATACGGGTCCATCAATCACACGTACCACCTGGATGTTGTGGAGCGATCGCCTCACCGGCCCATCCTCCAAGCCGGACTGCCGGCAAATGCCTCCACAGTGGTCGGAGGAGACGTAGAGTTTGTCTGCAAGGTTTACAGTGATGCCCAGCCCCACATCCAGTGGATCAAGCACGTGGAAAAGAACGGCAGTAAATACGGGCCCGACGGGCTGCCCTACCTCAAGGTTCTCAAGGCCGCCGGTGTTAACACCACGGACAAAGAGATTGAGGTTCTCTATATTCGGAATGTAACTTTTGAGGACGCTGGGGAATATACGTGCTTGGCGGGTAATTCTATTGGGATATCCTTTCACTCTGCATGGTTGACAGTTCTGCCAGCGCCTGGAAGAGAAAAGGAGATTACAGCTTCCCCAGACTACCTGGAGATAGCCATTTACTGCATAGGGGTCTTCTTAATCGCCTGTATGGTGGTAACAGTCATCCTGTGCCGAATGAAGAACACGACCAAGAAGCCAGACTTCAGCAGCCAGCCGGCTGTGCACAAGCTGACCAAACGTATCCCCCTGCGGAGACAGGTAACAGTTTCGGCTGAGTCCAGCTCCTCCATGAACTCCAACACCCCGCTGGTGAGGATAACAACACGCCTCTCTTCAACGGCAGACACCCCCATGCTGGCAGGGGTCTCCGAGTATGAACTTCCAGAGGACCCAAAATGGGAGTTTCCAAGAGATAAGCTGACACTGGGCAAGCCCCTGGGAGAAGGTTGCTTTGGGCAAGTGGTCATGGCGGAAGCAGTGGGAATTGACAAAGACAAGCCCAAGGAGGCGGTCACCGTGGCCGTGAAGATGTTGAAAGATGATGCCACAGAGAAAGACCTTTCTGATCTGGTGTCAGAGATGGAGATGATGAAGATGATTGGGAAACACAAGAATATCATAAATCTTCTTGGAGCCTGCACACAGGATGGGCCTCTCTATGTCATAGTTGAGTATGCCTCTAAAGGCAACCTCCGAGAATACCTCCGAGCCCGGAGGCCACCCGGGATGGAGTACTCCTATGACATTAACCGTGTTCCTGAGGAGCAGATGACCTTCAAGGACTTGGTGTCATGCACCTACCAGCTGGCCAGAGGCATGGAGTACTTGGCTTCCCAAAAATGTATTCATCGAGATTTAGCAGCCAGAAATGTTTTGGTAACAGAAAACAATGTGATGAAAATAGCAGACTTTGGACTCGCCAGAGATATCAACAATATAGACTATTACAAAAAGACCACCAATGGGCGGCTTCCAGTCAAGTGGATGGCTCCAGAAGCCCTGTTTGATAGAGTATACACTCATCAGAGTGATGTCTGGTCCTTCGGGGTGTTAATGTGGGAGATCTTCACTTTAGGGGGCTCGCCCTACCCAGGGATTCCCGTGGAGGAACTTTTTAAGCTGCTGAAGGAAGGACACAGAATGGATAAGCCAGCCAACTGCACCAACGAACTGTACATGATGATGAGGGACTGTTGGCATGCAGTGCCCTCCCAGAGACCAACGTTCAAGCAGTTGGTAGAAGACTTGGATCGAATTCTCACTCTCACAACCAATGAGGAATACTTGGACCTCAGCCAACCTCTCGAACAGTATTCACCTAGTTACCCTGACACAAGAAGTTCTTGTTCTTCAGGAGATGATTCTGTTTTTTCTCCAGACCCCATGCCTTACGAACCATGCCTTCCTCAGTATCCACACATAAACGGCAGTGTTAAAACATGAATGACTGTGTCTGCCTGTCCCCAAACAGGACAGCACTGGGAACCTAGCTACACTGAGCAGGGAGACCATGCCTCCCAGAGCTTGTTGTCTCCACTTGTATATATGGATCAGAGGAGTAAATAATTGGAAAAGTAATCAGCATATGTGTAAAGATTTATACAGTTGAAAACTTGTAATCTTCCCCAGGAGGAGAAGAAGGTTTCTGGAGCAGTGGACTGCCACAAGCCACCATGTAACCCCTCTCACCTGCCGTGCGTACTGGCTGTGGACCAGTAGGACTCAAGGTGGACGTGCGTTCTGCCTTCCTTGTTAATTTTGTAATAATTGGAGAAGATTTATGTCAGCACACACTTACAGAGCACAAATGCAGTATATAGGTGCTGGATGTATGTAAATATATTCAAATTATGTATAAATATATATTATATATTTACAAGGAGTTATTTTTTGTATTGATTTTAAATGGATGTCCCAATGCACCTAGAAAATTGGTCTCTCTTTTTTTAATAGCTATTTGCTAAATGCTGTTCTTACACATAATTTCTTAATTTTCACCGAGCAGAGGTGGAAAAATACTTTTGCTTTCAGGGAAAATGGTATAACGTTAATTTATTAATAAATTGGTAATATACAAAACAATTAATCATTTATAGTTTTTTTTGTAATTTAAGTGGCATTTCTATGCAGGCAGCACAGCAGACTAGTTAATCTATTGCTTGGACTTAACTAGTTATCAGATCCTTTGAAAAGAGAATATTTACAATATATGACTAATTTGGGGAAAATGAAGTTTTGATTTATTTGTGTTTAAATGCTGCTGTCAGACGATTGTTCTTAGACCTCCTAAATGCCCCATATTAAAAGAACTCATTCATAGGAAGGTGTTTCATTTTGGTGTGCAACCCTGTCATTACGTCAACGCAACGTCTAACTGGACTTCCCAAGATAAATGGTACCAGCGTCCTCTTAAAAGATGCCTTAATCCATTCCTTGAGGACAGACCTTAGTTGAAATGATAGCAGAATGTGCTTCTCTCTGGCAGCTGGCCTTCTGCTTCTGAGTTGCACATTAATCAGATTAGCCTGTATTCTCTTCAGTGAATTTTGATAATGGCTTCCAGACTCTTTGGCGTTGGAGACGCCTGTTAGGATCTTCAAGTCCCATCATAGAAAATTGAAACACAGAGTTGTTCTGCTGATAGTTTTGGGGATACGTCCATCTTTTTAAGGGATTGCTTTCATCTAATTCTGGCAGGACCTCACCAAAAGATCCAGCCTCATACCTACATCAGACAAAATATCGCCGTTGTTCCTTCTGTACTAAAGTATTGTGTTTTGCTTTGGAAACACCCACTCACTTTGCAATAGCCGTGCAAGATGAATGCAGATTACACTGATCTTATGTGTTACAAAATTGGAGAAAGTATTTAATAAAACCTGTTAATTTTTATACTGACAATAAAAATGTTTCTACAGATATTAATGTTAACAAGACAAAATAAATGTCACGCAACTTA

SEQ ID NO: 22 - protein, 821 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 23 - protein, 3990 aa, Homo sapiens
ACAGACTCTCCCGCAGAACTGACCCCAGCAAGAAGCCTTTGGGAGCAGTAGAGATGGAGTTTCACTATGTTGCCCAGGCTAGCCTTGAACTCCTGACCTCAGATGATCTGCCCGCGCAGGCCTCCCGAAGTGCTGGGATTACAGGCATGAGCCACCGCACCTGGCCTGCCAACTCTTGTTAAGATCTCGAAGGAAACATTTTCTTCCCCTGAAGGAAACCCAGCTATGCAGACACCAGCTGATAATCTTGCATTCCTGAAAGATGTTGCACCCCTATGGCAAGTGGCGGCTGCTGAGGCTCTGACGTGACTCCCAGGCATGAACGCTCTCAGCTGTGTTTACCTCAGCTCCTCGGGAGGGAGCCTGGGAGACTGACGCCTGAGTTTTACATCAGTGTCAAAACCCAAGCACAACCTAGGGAGGGACCTCCTGCCTAGTGTGTGTGGGTCAGGAGATAGAAAAGCTCTCACTGAGTAAACTGGACAAGGTCAATATACCTCGCTGATTGAGAAGACTTCACTCTCTCTGCAAAGAGACGTGTGTGTTTTAGAGGAAGTGGGAGCCCCAGCCGATTCTGCAAGACTTCCGAGAGTCAGATATCCAGACAGAAGATGCGGACACCTGGGTGACCAGACAGCGAAGAGGAAAGAACAAAACGAGCATGTGCCAAGCCTGTGAGGGAGAAAGGGCAACAAACCAGTGACCTTCCACAGAAATGTGTTTAAACAAAACAAAACAGCTCTTTGGCGTTGCTAAGAGACTGCCATTTTGGAGGAAAGAGCGATCGCCTCACCGGCCCATCCTCCAAGCCGGACTGCCGGCAAATGCCTCCACAGTGGTCGGAGGAGACGTAGAGTTTGTCTGCAAGGTTTACAGTGATGCCCAGCCCCACATCCAGTGGATCAAGCACGTGGAAAAGAACGGCAGTAAATACGGGCCCGACGGGCTGCCCTACCTCAAGGTTCTCAAGGCCGCCGGTGTTAACACCACGGACAAAGAGATTGAGGTTCTCTATATTCGGAATGTAACTTTTGAGGACGCTGGGGAATATACGTGCTTGGCGGGTAATTCTATTGGGATATCCTTTCACTCTGCATGGTTGACAGTTCTGCCAGCGCCTGGAAGAGAAAAGGAGATTACAGCTTCCCCAGACTACCTGGAGATAGCCATTTACTGCATAGGGGTCTTCTTAATCGCCTGTATGGTGGTAACAGTCATCCTGTGCCGAATGAAGAACACGACCAAGAAGCCAGACTTCAGCAGCCAGCCGGCTGTGCACAAGCTGACCAAACGTATCCCCCTGCGGAGACAGGTAACAGTTTCGGCTGAGTCCAGCTCCTCCATGAACTCCAACACCCCGCTGGTGAGGATAACAACACGCCTCTCTTCAACGGCAGACACCCCCATGCTGGCAGGGGTCTCCGAGTATGAACTTCCAGAGGACCCAAAATGGGAGTTTCCAAGAGATAAGCTGACACTGGGCAAGCCCCTGGGAGAAGGTTGCTTTGGGCAAGTGGTCATGGCGGAAGCAGTGGGAATTGACAAAGACAAGCCCAAGGAGGCGGTCACCGTGGCCGTGAAGATGTTGAAAGATGATGCCACAGAGAAAGACCTTTCTGATCTGGTGTCAGAGATGGAGATGATGAAGATGATTGGGAAACACAAGAATATCATAAATCTTCTTGGAGCCTGCACACAGGATGGGCCTCTCTATGTCATAGTTGAGTATGCCTCTAAAGGCAACCTCCGAGAATACCTCCGAGCCCGGAGGCCACCCGGGATGGAGTACTCCTATGACATTAACCGTGTTCCTGAGGAGCAGATGACCTTCAAGGACTTGGTGTCATGCACCTACCAGCTGGCCAGAGGCATGGAGTACTTGGCTTCCCAAAAATGTATTCATCGAGATTTAGCAGCCAGAAATGTTTTGGTAACAGAAAACAATGTGATGAAAATAGCAGACTTTGGACTCGCCAGAGATATCAACAATATAGACTATTACAAAAAGACCACCAATGGGCGGCTTCCAGTCAAGTGGATGGCTCCAGAAGCCCTGTTTGATAGAGTATACACTCATCAGAGTGATGTCTGGTCCTTCGGGGTGTTAATGTGGGAGATCTTCACTTTAGGGGGCTCGCCCTACCCAGGGATTCCCGTGGAGGAACTTTTTAAGCTGCTGAAGGAAGGACACAGAATGGATAAGCCAGCCAACTGCACCAACGAACTGTACATGATGATGAGGGACTGTTGGCATGCAGTGCCCTCCCAGAGACCAACGTTCAAGCAGTTGGTAGAAGACTTGGATCGAATTCTCACTCTCACAACCAATGAGGAATACTTGGACCTCAGCCAACCTCTCGAACAGTATTCACCTAGTTACCCTGACACAAGAAGTTCTTGTTCTTCAGGAGATGATTCTGTTTTTTCTCCAGACCCCATGCCTTACGAACCATGCCTTCCTCAGTATCCACACATAAACGGCAGTGTTAAAACATGAATGACTGTGTCTGCCTGTCCCCAAACAGGACAGCACTGGGAACCTAGCTACACTGAGCAGGGAGACCATGCCTCCCAGAGCTTGTTGTCTCCACTTGTATATATGGATCAGAGGAGTAAATAATTGGAAAAGTAATCAGCATATGTGTAAAGATTTATACAGTTGAAAACTTGTAATCTTCCCCAGGAGGAGAAGAAGGTTTCTGGAGCAGTGGACTGCCACAAGCCACCATGTAACCCCTCTCACCTGCCGTGCGTACTGGCTGTGGACCAGTAGGACTCAAGGTGGACGTGCGTTCTGCCTTCCTTGTTAATTTTGTAATAATTGGAGAAGATTTATGTCAGCACACACTTACAGAGCACAAATGCAGTATATAGGTGCTGGATGTATGTAAATATATTCAAATTATGTATAAATATATATTATATATTTACAAGGAGTTATTTTTTGTATTGATTTTAAATGGATGTCCCAATGCACCTAGAAAATTGGTCTCTCTTTTTTTAATAGCTATTTGCTAAATGCTGTTCTTACACATAATTTCTTAATTTTCACCGAGCAGAGGTGGAAAAATACTTTTGCTTTCAGGGAAAATGGTATAACGTTAATTTATTAATAAATTGGTAATATACAAAACAATTAATCATTTATAGTTTTTTTTGTAATTTAAGTGGCATTTCTATGCAGGCAGCACAGCAGACTAGTTAATCTATTGCTTGGACTTAACTAGTTATCAGATCCTTTGAAAAGAGAATATTTACAATATATGACTAATTTGGGGAAAATGAAGTTTTGATTTATTTGTGTTTAAATGCTGCTGTCAGACGATTGTTCTTAGACCTCCTAAATGCCCCATATTAAAAGAACTCATTCATAGGAAGGTGTTTCATTTTGGTGTGCAACCCTGTCATTACGTCAACGCAACGTCTAACTGGACTTCCCAAGATAAATGGTACCAGCGTCCTCTTAAAAGATGCCTTAATCCATTCCTTGAGGACAGACCTTAGTTGAAATGATAGCAGAATGTGCTTCTCTCTGGCAGCTGGCCTTCTGCTTCTGAGTTGCACATTAATCAGATTAGCCTGTATTCTCTTCAGTGAATTTTGATAATGGCTTCCAGACTCTTTGGCGTTGGAGACGCCTGTTAGGATCTTCAAGTCCCATCATAGAAAATTGAAACACAGAGTTGTTCTGCTGATAGTTTTGGGGATACGTCCATCTTTTTAAGGGATTGCTTTCATCTAATTCTGGCAGGACCTCACCAAAAGATCCAGCCTCATACCTACATCAGACAAAATATCGCCGTTGTTCCTTCTGTACTAAAGTATTGTGTTTTGCTTTGGAAACACCCACTCACTTTGCAATAGCCGTGCAAGATGAATGCAGATTACACTGATCTTATGTGTTACAAAATTGGAGAAAGTATTTAATAAAACCTGTTAATTTTTATACTGACAATAAAAATGTTTCTACAGATATTAATGTTAACAAGA

SEQ ID NO: 24 - protein, 593 aa, Homo sapiens
MCLNKTKQLFGVAKRLPFWRKERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 25 - protein, 3803 aa, Homo sapiens
TGACTGCAGCAGCAGCGGCAGCGCCTCGGTTCCTGAGCCCACCGCAGGCTGAAGGCATTGCGCGTAGTCCATGCCCGTAGAGGAAGTGTGCAGATGGGATTAACGTCCACATGGAGATATGGAAGAGGACCGGGGATTGGTACCGTAACCATGGTCAGCTGGGGTCGTTTCATCTGCCTGGTCGTGGTCACCATGGCAACCTTGTCCCTGGCCCGGCCCTCCTTCAGTTTAGTTGAGGATACCACATTAGAGCCAGAAGAGCCACCAACCAAATACCAAATCTCTCAACCAGAAGTGTACGTGGCTGCGCCAGGGGAGTCGCTAGAGGTGCGCTGCCTGTTGAAAGATGCCGCCGTGATCAGTTGGACTAAGGATGGGGTGCACTTGGGGCCCAACAATAGGACAGTGCTTATTGGGGAGTACTTGCAGATAAAGGGCGCCACGCCTAGAGACTCCGGCCTCTATGCTTGTACTGCCAGTAGGACTGTAGACAGTGAAACTTGGTACTTCATGGTGAATGTCACAGATGCCATCTCATCCGGAGATGATGAGGATGACACCGATGGTGCGGAAGATTTTGTCAGTGAGAACAGTAACAACAAGAGAGCACCATACTGGACCAACACAGAAAAGATGGAAAAGCGGCTCCATGCTGTGCCTGCGGCCAACACTGTCAAGTTTCGCTGCCCAGCCGGGGGGAACCCAATGCCAACCATGCGGTGGCTGAAAAACGGGAAGGAGTTTAAGCAGGAGCATCGCATTGGAGGCTACAAGGTACGAAACCAGCACTGGAGCCTCATTATGGAAAGTGTGGTCCCATCTGACAAGGGAAATTATACCTGTGTAGTGGAGAATGAATACGGGTCCATCAATCACACGTACCACCTGGATGTTGTGGCGCCTGGAAGAGAAAAGGAGATTACAGCTTCCCCAGACTACCTGGAGATAGCCATTTACTGCATAGGGGTCTTCTTAATCGCCTGTATGGTGGTAACAGTCATCCTGTGCCGAATGAAGAACACGACCAAGAAGCCAGACTTCAGCAGCCAGCCGGCTGTGCACAAGCTGACCAAACGTATCCCCCTGCGGAGACAGGTAACAGTTTCGGCTGAGTCCAGCTCCTCCATGAACTCCAACACCCCGCTGGTGAGGATAACAACACGCCTCTCTTCAACGGCAGACACCCCCATGCTGGCAGGGGTCTCCGAGTATGAACTTCCAGAGGACCCAAAATGGGAGTTTCCAAGAGATAAGCTGACACTGGGCAAGCCCCTGGGAGAAGGTTGCTTTGGGCAAGTGGTCATGGCGGAAGCAGTGGGAATTGACAAAGACAAGCCCAAGGAGGCGGTCACCGTGGCCGTGAAGATGTTGAAAGATGATGCCACAGAGAAAGACCTTTCTGATCTGGTGTCAGAGATGGAGATGATGAAGATGATTGGGAAACACAAGAATATCATAAATCTTCTTGGAGCCTGCACACAGGATGGGCCTCTCTATGTCATAGTTGAGTATGCCTCTAAAGGCAACCTCCGAGAATACCTCCGAGCCCGGAGGCCACCCGGGATGGAGTACTCCTATGACATTAACCGTGTTCCTGAGGAGCAGATGACCTTCAAGGACTTGGTGTCATGCACCTACCAGCTGGCCAGAGGCATGGAGTACTTGGCTTCCCAAAAATGTATTCATCGAGATTTAGCAGCCAGAAATGTTTTGGTAACAGAAAACAATGTGATGAAAATAGCAGACTTTGGACTCGCCAGAGATATCAACAATATAGACTATTACAAAAAGACCACCAATGGGCGGCTTCCAGTCAAGTGGATGGCTCCAGAAGCCCTGTTTGATAGAGTATACACTCATCAGAGTGATGTCTGGTCCTTCGGGGTGTTAATGTGGGAGATCTTCACTTTAGGGGGCTCGCCCTACCCAGGGATTCCCGTGGAGGAACTTTTTAAGCTGCTGAAGGAAGGACACAGAATGGATAAGCCAGCCAACTGCACCAACGAACTGTACATGATGATGAGGGACTGTTGGCATGCAGTGCCCTCCCAGAGACCAACGTTCAAGCAGTTGGTAGAAGACTTGGATCGAATTCTCACTCTCACAACCAATGAGGAATACTTGGACCTCAGCCAACCTCTCGAACAGTATTCACCTAGTTACCCTGACACAAGAAGTTCTTGTTCTTCAGGAGATGATTCTGTTTTTTCTCCAGACCCCATGCCTTACGAACCATGCCTTCCTCAGTATCCACACATAAACGGCAGTGTTAAAACATGAATGACTGTGTCTGCCTGTCCCCAAACAGGACAGCACTGGGAACCTAGCTACACTGAGCAGGGAGACCATGCCTCCCAGAGCTTGTTGTCTCCACTTGTATATATGGATCAGAGGAGTAAATAATTGGAAAAGTAATCAGCATATGTGTAAAGATTTATACAGTTGAAAACTTGTAATCTTCCCCAGGAGGAGAAGAAGGTTTCTGGAGCAGTGGACTGCCACAAGCCACCATGTAACCCCTCTCACCTGCCGTGCGTACTGGCTGTGGACCAGTAGGACTCAAGGTGGACGTGCGTTCTGCCTTCCTTGTTAATTTTGTAATAATTGGAGAAGATTTATGTCAGCACACACTTACAGAGCACAAATGCAGTATATAGGTGCTGGATGTATGTAAATATATTCAAATTATGTATAAATATATATTATATATTTACAAGGAGTTATTTTTTGTATTGATTTTAAATGGATGTCCCAATGCACCTAGAAAATTGGTCTCTCTTTTTTTAATAGCTATTTGCTAAATGCTGTTCTTACACATAATTTCTTAATTTTCACCGAGCAGAGGTGGAAAAATACTTTTGCTTTCAGGGAAAATGGTATAACGTTAATTTATTAATAAATTGGTAATATACAAAACAATTAATCATTTATAGTTTTTTTTGTAATTTAAGTGGCATTTCTATGCAGGCAGCACAGCAGACTAGTTAATCTATTGCTTGGACTTAACTAGTTATCAGATCCTTTGAAAAGAGAATATTTACAATATATGACTAATTTGGGGAAAATGAAGTTTTGATTTATTTGTGTTTAAATGCTGCTGTCAGACGATTGTTCTTAGACCTCCTAAATGCCCCATATTAAAAGAACTCATTCATAGGAAGGTGTTTCATTTTGGTGTGCAACCCTGTCATTACGTCAACGCAACGTCTAACTGGACTTCCCAAGATAAATGGTACCAGCGTCCTCTTAAAAGATGCCTTAATCCATTCCTTGAGGACAGACCTTAGTTGAAATGATAGCAGAATGTGCTTCTCTCTGGCAGCTGGCCTTCTGCTTCTGAGTTGCACATTAATCAGATTAGCCTGTATTCTCTTCAGTGAATTTTGATAATGGCTTCCAGACTCTTTGGCGTTGGAGACGCCTGTTAGGATCTTCAAGTCCCATCATAGAAAATTGAAACACAGAGTTGTTCTGCTGATAGTTTTGGGGATACGTCCATCTTTTTAAGGGATTGCTTTCATCTAATTCTGGCAGGACCTCACCAAAAGATCCAGCCTCATACCTACATCAGACAAAATATCGCCGTTGTTCCTTCTGTACTAAAGTATTGTGTTTTGCTTTGGAAACACCCACTCACTTTGCAATAGCCGTGCAAGATGAATGCAGATTACACTGATCTTATGTGTTACAAAATTGGAGAAAGTATTTAATAAAACCTGTTAATTTTTATACTGACAATAAAAATGTTTCTACAGATATTAATGTTAACAAGACAAAATAAATGTCACGCAACTTATTTTTTT

SEQ ID NO: 26 - protein, 709 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 27 - protein, 3690 aa, Homo sapiens
AATTTGTTGAGGAATTTCCCCCTAGCCTTGACCCCTTGACAGCTCCCGCTCCTACTCAGTGCTGGGGAGAAGTAGGGAGGCCTTAAGCGAAGAGATGGGTCTGCACTTTGGAGGAGCCGGACACTGTTGACTTTCCTGATGTGAAATCTACCCAGGAACAAAACACCAGTGACTGCAGCAGCAGCGGCAGCGCCTCGGTTCCTGAGCCCACCGCAGGCTGAAGGCATTGCGCGTAGTCCATGCCCGTAGAGGAAGTGTGCAGATGGGATTAACGTCCACATGGAGATATGGAAGAGGACCGGGGATTGGTACCGTAACCATGGTCAGCTGGGGTCGTTTCATCTGCCTGGTCGTGGTCACCATGGCAACCTTGTCCCTGGCCCGGCCCTCCTTCAGTTTAGTTGAGGATACCACATTAGAGCCAGAAGATGCCATCTCATCCGGAGATGATGAGGATGACACCGATGGTGCGGAAGATTTTGTCAGTGAGAACAGTAACAACAAGAGAGCACCATACTGGACCAACACAGAAAAGATGGAAAAGCGGCTCCATGCTGTGCCTGCGGCCAACACTGTCAAGTTTCGCTGCCCAGCCGGGGGGAACCCAATGCCAACCATGCGGTGGCTGAAAAACGGGAAGGAGTTTAAGCAGGAGCATCGCATTGGAGGCTACAAGGTACGAAACCAGCACTGGAGCCTCATTATGGAAAGTGTGGTCCCATCTGACAAGGGAAATTATACCTGTGTAGTGGAGAATGAATACGGGTCCATCAATCACACGTACCACCTGGATGTTGTGGAGCGATCGCCTCACCGGCCCATCCTCCAAGCCGGACTGCCGGCAAATGCCTCCACAGTGGTCGGAGGAGACGTAGAGTTTGTCTGCAAGGTTTACAGTGATGCCCAGCCCCACATCCAGTGGATCAAGCACGTGGAAAAGAACGGCAGTAAATACGGGCCCGACGGGCTGCCCTACCTCAAGGTTCTCAAGGCCGCCGGTGTTAACACCACGGACAAAGAGATTGAGGTTCTCTATATTCGGAATGTAACTTTTGAGGACGCTGGGGAATATACGTGCTTGGCGGGTAATTCTATTGGGATATCCTTTCACTCTGCATGGTTGACAGTTCTGCCAGCGCCTGGAAGAGAAAAGGAGATTACAGCTTCCCCAGACTACCTGGAGATAGCCATTTACTGCATAGGGGTCTTCTTAATCGCCTGTATGGTGGTAACAGTCATCCTGTGCCGAATGAAGAACACGACCAAGAAGCCAGACTTCAGCAGCCAGCCGGCTGTGCACAAGCTGACCAAACGTATCCCCCTGCGGAGACAGGTAACAGTTTCGGCTGAGTCCAGCTCCTCCATGAACTCCAACACCCCGCTGGTGAGGATAACAACACGCCTCTCTTCAACGGCAGACACCCCCATGCTGGCAGGGGTCTCCGAGTATGAACTTCCAGAGGACCCAAAATGGGAGTTTCCAAGAGATAAGCTGACACTGGGCAAGCCCCTGGGAGAAGGTTGCTTTGGGCAAGTGGTCATGGCGGAAGCAGTGGGAATTGACAAAGACAAGCCCAAGGAGGCGGTCACCGTGGCCGTGAAGATGTTGAAAGATGATGCCACAGAGAAAGACCTTTCTGATCTGGTGTCAGAGATGGAGATGATGAAGATGATTGGGAAACACAAGAATATCATAAATCTTCTTGGAGCCTGCACACAGGATGGGCCTCTCTATGTCATAGTTGAGTATGCCTCTAAAGGCAACCTCCGAGAATACCTCCGAGCCCGGAGGCCACCCGGGATGGAGTACTCCTATGACATTAACCGTGTTCCTGAGGAGCAGATGACCTTCAAGGACTTGGTGTCATGCACCTACCAGCTGGCCAGAGGCATGGAGTACTTGGCTTCCCAAAAATGTATTCATCGAGATTTAGCAGCCAGAAATGTTTTGGTAACAGAAAACAATGTGATGAAAATAGCAGACTTTGGACTCGCCAGAGATATCAACAATATAGACTATTACAAAAAGACCACCAATGGGCGGCTTCCAGTCAAGTGGATGGCTCCAGAAGCCCTGTTTGATAGAGTATACACTCATCAGAGTGATGTCTGGTCCTTCGGGGTGTTAATGTGGGAGATCTTCACTTTAGGGGGCTCGCCCTACCCAGGGATTCCCGTGGAGGAACTTTTTAAGCTGCTGAAGGAAGGACACAGAATGGATAAGCCAGCCAACTGCACCAACGAACTGTACATGATGATGAGGGACTGTTGGCATGCAGTGCCCTCCCAGAGACCAACGTTCAAGCAGTTGGTAGAAGACTTGGATCGAATTCTCACTCTCACAACCAATGAGGAGGAGAAGAAGGTTTCTGGAGCAGTGGACTGCCACAAGCCACCATGTAACCCCTCTCACCTGCCGTGCGTACTGGCTGTGGACCAGTAGGACTCAAGGTGGACGTGCGTTCTGCCTTCCTTGTTAATTTTGTAATAATTGGAGAAGATTTATGTCAGCACACACTTACAGAGCACAAATGCAGTATATAGGTGCTGGATGTATGTAAATATATTCAAATTATGTATAAATATATATTATATATTTACAAGGAGTTATTTTTTGTATTGATTTTAAATGGATGTCCCAATGCACCTAGAAAATTGGTCTCTCTTTTTTTAATAGCTATTTGCTAAATGCTGTTCTTACACATAATTTCTTAATTTTCACCGAGCAGAGGTGGAAAAATACTTTTGCTTTCAGGGAAAATGGTATAACGTTAATTTATTAATAAATTGGTAATATACAAAACAATTAATCATTTATAGTTTTTTTTGTAATTTAAGTGGCATTTCTATGCAGGCAGCACAGCAGACTAGTTAATCTATTGCTTGGACTTAACTAGTTATCAGATCCTTTGAAAAGAGAATATTTACAATATATGACTAATTTGGGGAAAATGAAGTTTTGATTTATTTGTGTTTAAATGCTGCTGTCAGACGATTGTTCTTAGACCTCCTAAATGCCCCATATTAAAAGAACTCATTCATAGGAAGGTGTTTCATTTTGGTGTGCAACCCTGTCATTACGTCAACGCAACGTCTAACTGGACTTCCCAAGATAAATGGTACCAGCGTCCTCTTAAAAGATGCCTTAATCCATTCCTTGAGGACAGACCTTAGTTGAAATGATAGCAGAATGTGCTTCTCTCTGGCAGCTGGCCTTCTGCTTCTGAGTTGCACATTAATCAGATTAGCCTGTATTCTCTTCAGTGAATTTTGATAATGGCTTCCAGACTCTTTGGCGTTGGAGACGCCTGTTAGGATCTTCAAGTCCCATCATAGAAAATTGAAACACAGAGTTGTTCTGCTGATAGTTTTGGGGATACGTCCATCTTTTTAAGGGATTGCTTTCATCTAATTCTGGCAGGACCTCACCAAAAGATCCAGCCTCATACCTACATCAGACAAAATATCGCCGTTGTTCCTTCTGTACTAAAGTATTGTGTTTTGCTTTGGAAACACCCACTCACTTTGCAATAGCCGTGCAAGATGAATGCAGATTACACTGATCTTATGTGTTACAAAATTGGAGAAAGTATTTAATAAAACCTGTTAATTTTTATACTGACAATAAAAATGTTTCTACAGATATTAATGTTAACAAGACAAAATAAATGTCACGCAACTTATTTTTTT

SEQ ID NO: 28 - protein, 707 aa, Homo sapiens
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEEKKVSGAVDCHKPPCNPSHLPCVLAVDQ

SEQ ID NO: 29 - protein, 3547 aa, Homo sapiens
GGCGGCGGCTGGAGGAGAGCGCGGTGGAGAGCCGAGCGGGCGGGCGGCGGGTGCGGAGCGGGCGAGGGAGCGCGCGCGGCCGCCACAAAGCTCGGGCGCCGCGGGGCTGCATGCGGCGTACCTGGCCCGGCGCGGCGACTGCTCTCCGGGCTGGCGGGGGCCGGCCGCGAGCCCCGGGGGCCCCGAGGCCGCAGCTTGCCTGCGCGCTCTGAGCCTTCGCAACTCGCGAGCAAAGTTTGGTGGAGGCAACGCCAAGCCTGAGTCCTTTCTTCCTCTCGTTCCCCAAATCCGAGGGCAGCCCGCGGGCGTCATGCCCGCGCTCCTCCGCAGCCTGGGGTACGCGTGAAGCCCGGGAGGCTTGGCGCCGGCGAAGACCCAAGGACCACTCTTCTGCGTTTGGAGTTGCTCCCCGCAACCCCGGGCTCGTCGCTTTCTCCATCCCGACCCACGCGGGGCGCGGGGACAACACAGGTCGCGGAGGAGCGTTGCCATTCAAGTGACTGCAGCAGCAGCGGCAGCGCCTCGGTTCCTGAGCCCACCGCAGGCTGAAGGCATTGCGCGTAGTCCATGCCCGTAGAGGAAGTGTGCAGATGGGATTAACGTCCACATGGAGATATGGAAGAGGACCGGGGATTGGTACCGTAACCATGGTCAGCTGGGGTCGTTTCATCTGCCTGGTCGTGGTCACCATGGCAACCTTGTCCCTGGCCCGGCCCTCCTTCAGTTTAGTTGAGGATACCACATTAGAGCCAGAAGGAGCACCATACTGGACCAACACAGAAAAGATGGAAAAGCGGCTCCATGCTGTGCCTGCGGCCAACACTGTCAAGTTTCGCTGCCCAGCCGGGGGGAACCCAATGCCAACCATGCGGTGGCTGAAAAACGGGAAGGAGTTTAAGCAGGAGCATCGCATTGGAGGCTACAAGGTACGAAACCAGCACTGGAGCCTCATTATGGAAAGTGTGGTCCCATCTGACAAGGGAAATTATACCTGTGTAGTGGAGAATGAATACGGGTCCATCAATCACACGTACCACCTGGATGTTGTGGAGCGATCGCCTCACCGGCCCATCCTCCAAGCCGGACTGCCGGCAAATGCCTCCACAGTGGTCGGAGGAGACGTAGAGTTTGTCTGCAAGGTTTACAGTGATGCCCAGCCCCACATCCAGTGGATCAAGCACGTGGAAAAGAACGGCAGTAAATACGGGCCCGACGGGCTGCCCTACCTCAAGGTTCTCAAGGCCGCCGGTGTTAACACCACGGACAAAGAGATTGAGGTTCTCTATATTCGGAATGTAACTTTTGAGGACGCTGGGGAATATACGTGCTTGGCGGGTAATTCTATTGGGATATCCTTTCACTCTGCATGGTTGACAGTTCTGCCAGCGCCTGGAAGAGAAAAGGAGATTACAGCTTCCCCAGACTACCTGGAGATAGCCATTTACTGCATAGGGGTCTTCTTAATCGCCTGTATGGTGGTAACAGTCATCCTGTGCCGAATGAAGAACACGACCAAGAAGCCAGACTTCAGCAGCCAGCCGGCTGTGCACAAGCTGACCAAACGTATCCCCCTGCGGAGACAGGTTTCGGCTGAGTCCAGCTCCTCCATGAACTCCAACACCCCGCTGGTGAGGATAACAACACGCCTCTCTTCAACGGCAGACACCCCCATGCTGGCAGGGGTCTCCGAGTATGAACTTCCAGAGGACCCAAAATGGGAGTTTCCAAGAGATAAGCTGACACTGGGCAAGCCCCTGGGAGAAGGTTGCTTTGGGCAAGTGGTCATGGCGGAAGCAGTGGGAATTGACAAAGACAAGCCCAAGGAGGCGGTCACCGTGGCCGTGAAGATGTTGAAAGATGATGCCACAGAGAAAGACCTTTCTGATCTGGTGTCAGAGATGGAGATGATGAAGATGATTGGGAAACACAAGAATATCATAAATCTTCTTGGAGCCTGCACACAGGATGGGCCTCTCTATGTCATAGTTGAGTATGCCTCTAAAGGCAACCTCCGAGAATACCTCCGAGCCCGGAGGCCACCCGGGATGGAGTACTCCTATGACATTAACCGTGTTCCTGAGGAGCAGATGACCTTCAAGGACTTGGTGTCATGCACCTACCAGCTGGCCAGAGGCATGGAGTACTTGGCTTCCCAAAAATGTATTCATCGAGATTTAGCAGCCAGAAATGTTTTGGTAACAGAAAACAATGTGATGAAAATAGCAGACTTTGGACTCGCCAGAGATATCAACAATATAGACTATTACAAAAAGACCACCAATGGGCGGCTTCCAGTCAAGTGGATGGCTCCAGAAGCCCTGTTTGATAGAGTATACACTCATCAGAGTGATGTCTGGTCCTTCGGGGTGTTAATGTGGGAGATCTTCACTTTAGGGGGCTCGCCCTACCCAGGGATTCCCGTGGAGGAACTTTTTAAGCTGCTGAAGGAAGGACACAGAATGGATAAGCCAGCCAACTGCACCAACGAACTGTACATGATGATGAGGGACTGTTGGCATGCAGTGCCCTCCCAGAGACCAACGTTCAAGCAGTTGGTAGAAGACTTGGATCGAATTCTCACTCTCACAACCAATGAGGAATACTTGGACCTCAGCCAACCTCTCGAACAGTATTCACCTAGTTACCCTGACACAAGAAGTTCTTGTTCTTCAGGAGATGATTCTGTTTTTTCTCCAGACCCCATGCCTTACGAACCATGCCTTCCTCAGTATCCACACATAAACGGCAGTGTTAAAACATGAATGACTGTGTCTGCCTGTCCCCAAACAGGACAGCACTGGGAACCTAGCTACACTGAGCAGGGAGACCATGCCTCCCAGAGCTTGTTGTCTCCACTTGTATATATGGATCAGAGGAGTAAATAATTGGAAAAGTAATCAGCATATGTGTAAAGATTTATACAGTTGAAAACTTGTAATCTTCCCCAGGAGGAGAAGAAGGTTTCTGGAGCAGTGGACTGCCACAAGCCACCATGTAACCCCTCTCACCTGCCGTGCGTACTGGCTGTGGACCAGTAGGACTCAAGGTGGACGTGCGTTCTGCCTTCCTTGTTAATTTTGTAATAATTGGAGAAGATTTATGTCAGCACACACTTACAGAGCACAAATGCAGTATATAGGTGCTGGATGTATGTAAATATATTCAAATTATGTATAAATATATATTATATATTTACAAGGAGTTATTTTTTGTATTGATTTTAAATGGATGTCCCAATGCACCTAGAAAATTGGTCTCTCTTTTTTTAATAGCTATTTGCTAAATGCTGTTCTTACACATAATTTCTTAATTTTCACCGAGCAGAGGTGGAAAAATACTTTTGCTTTCAGGGAAAATGGTATAACGTTAATTTATTAATAAATTGGTAATATACAAAACAATTAATCATTTATAGTTTTTTTTGTAATTTAAGTGGCATTTCTATGCAGGCAGCACAGCAGACTAGTTAATCTATTGCTTGGACTTAACTAGTTATCAGATCCTTTGAAAAGAGAATATTTACAATATATGACTAATTTGGGGAAAA

SEQ ID NO: 30 - protein, 704 aa, Homo sapiens
MVSWGRFICLVVVTMATLSLARPSFSLVEDTTLEPEGAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 31 - protein, 3244 aa, Homo sapiens
CCGGCCGCGAGCCCCGGGGGCCCCGAGGCCGCAGCTTGCCTGCGCGCTCTGAGCCTTCGCAACTCGCGAGCAAAGTTTGGTGGAGGCAACGCCAAGCCTGAGTCCTTTCTTCCTCTCGTTCCCCAAATCCGAGGGCAGCCCGCGGGCGTCATGCCCGCGCTCCTCCGCAGCCTGGGGTACGCGTGAAGCCCGGGAGGCTTGGCGCCGGCGAAGACCCAAGGACCACTCTTCTGCGTTTGGAGTTGCTCCCCGCAACCCCGGGCTCGTCGCTTTCTCCATCCCGACCCACGCGGGGCGCGGGGACAACACAGGTCGCGGAGGAGCGTTGCCATTCAAGTGACTGCAGCAGCAGCGGCAGCGCCTCGGTTCCTGAGCCCACCGCAGGCTGAAGGCATTGCGCGTAGTCCATGCCCGTAGAGGAAGTGTGCAGATGGGATTAACGTCCACATGGAGATATGGAAGAGGACCGGGGATTGGTACCGTAACCATGGTCAGCTGGGGTCGTTTCATCTGCCTGGTCGTGGTCACCATGGCAACCTTGTCCCTGGCCCGGCCCTCCTTCAGTTTAGTTGAGGATACCACATTAGAGCCAGAAGAGCCACCAACCAAATACCAAATCTCTCAACCAGAAGTGTACGTGGCTGCGCCAGGGGAGTCGCTAGAGGTGCGCTGCCTGTTGAAAGATGCCGCCGTGATCAGTTGGACTAAGGATGGGGTGCACTTGGGGCCCAACAATAGGACAGTGCTTATTGGGGAGTACTTGCAGATAAAGGGCGCCACGCCTAGAGACTCCGGCCTCTATGCTTGTACTGCCAGTAGGACTGTAGACAGTGAAACTTGGTACTTCATGGTGAATGTCACAGATGCCATCTCATCCGGAGATGATGAGGATGACACCGATGGTGCGGAAGATTTTGTCAGTGAGAACAGTAACAACAAGAGAGCACCATACTGGACCAACACAGAAAAGATGGAAAAGCGGCTCCATGCTGTGCCTGCGGCCAACACTGTCAAGTTTCGCTGCCCAGCCGGGGGGAACCCAATGCCAACCATGCGGTGGCTGAAAAACGGGAAGGAGTTTAAGCAGGAGCATCGCATTGGAGGCTACAAGGTACGAAACCAGCACTGGAGCCTCATTATGGAAAGTGTGGTCCCATCTGACAAGGGAAATTATACCTGTGTAGTGGAGAATGAATACGGGTCCATCAATCACACGTACCACCTGGATGTTGTGGAGCGATCGCCTCACCGGCCCATCCTCCAAGCCGGACTGCCGGCAAATGCCTCCACAGTGGTCGGAGGAGACGTAGAGTTTGTCTGCAAGGTTTACAGTGATGCCCAGCCCCACATCCAGTGGATCAAGCACGTGGAAAAGAACGGCAGTAAATACGGGCCCGACGGGCTGCCCTACCTCAAGGTTCTCAAGGTTTCGGCTGAGTCCAGCTCCTCCATGAACTCCAACACCCCGCTGGTGAGGATAACAACACGCCTCTCTTCAACGGCAGACACCCCCATGCTGGCAGGGGTCTCCGAGTATGAACTTCCAGAGGACCCAAAATGGGAGTTTCCAAGAGATAAGCTGACACTGGGCAAGCCCCTGGGAGAAGGTTGCTTTGGGCAAGTGGTCATGGCGGAAGCAGTGGGAATTGACAAAGACAAGCCCAAGGAGGCGGTCACCGTGGCCGTGAAGATGTTGAAAGATGATGCCACAGAGAAAGACCTTTCTGATCTGGTGTCAGAGATGGAGATGATGAAGATGATTGGGAAACACAAGAATATCATAAATCTTCTTGGAGCCTGCACACAGGATGGGCCTCTCTATGTCATAGTTGAGTATGCCTCTAAAGGCAACCTCCGAGAATACCTCCGAGCCCGGAGGCCACCCGGGATGGAGTACTCCTATGACATTAACCGTGTTCCTGAGGAGCAGATGACCTTCAAGGACTTGGTGTCATGCACCTACCAGCTGGCCAGAGGCATGGAGTACTTGGCTTCCCAAAAATGTATTCATCGAGATTTAGCAGCCAGAAATGTTTTGGTAACAGAAAACAATGTGATGAAAATAGCAGACTTTGGACTCGCCAGAGATATCAACAATATAGACTATTACAAAAAGACCACCAATGGGCGGCTTCCAGTCAAGTGGATGGCTCCAGAAGCCCTGTTTGATAGAGTATACACTCATCAGAGTGATGTCTGGTCCTTCGGGGTGTTAATGTGGGAGATCTTCACTTTAGGGGGCTCGCCCTACCCAGGGATTCCCGTGGAGGAACTTTTTAAGCTGCTGAAGGAAGGACACAGAATGGATAAGCCAGCCAACTGCACCAACGAACTGTACATGATGATGAGGGACTGTTGGCATGCAGTGCCCTCCCAGAGACCAACGTTCAAGCAGTTGGTAGAAGACTTGGATCGAATTCTCACTCTCACAACCAATGAGGAATACTTGGACCTCAGCCAACCTCTCGAACAGTATTCACCTAGTTACCCTGACACAAGAAGTTCTTGTTCTTCAGGAGATGATTCTGTTTTTTCTCCAGACCCCATGCCTTACGAACCATGCCTTCCTCAGTATCCACACATAAACGGCAGTGTTAAAACATGAATGACTGTGTCTGCCTGTCCCCAAACAGGACAGCACTGGGAACCTAGCTACACTGAGCAGGGAGACCATGCCTCCCAGAGCTTGTTGTCTCCACTTGTATATATGGATCAGAGGAGTAAATAATTGGAAAAGTAATCAGCATATGTGTAAAGATTTATACAGTTGAAAACTTGTAATCTTCCCCAGGAGGAGAAGAAGGTTTCTGGAGCAGTGGACTGCCACAAGCCACCATGTAACCCCTCTCACCTGCCGTGCGTACTGGCTGTGGACCAGTAGGACTCAAGGTGGACGTGCGTTCTGCCTTCCTTGTTAATTTTGTAATAATTGGAGAAGATTTATGTCAGCACACACTTACAGAGCACAAATGCAGTATATAGGTGCTGGATGTATGTAAATATATTCAAATTATGTATAAATATATATTATATATTTACAAGGAGTTATTTTTTGTATTGATTTTAAATGGATGTCCCAATGCACCTAGAAAATTGGTCTCTCTTTTTTTAATAGCTATTTGCTAAATGCTGTTCTTACACATAATTTCTTAATTTTCACCGAGCAGAGGTGGAAAAATACTTTTGCTTTCAGGGAAAATGGTATAACGTTAATTTATTAATAAATTGGTAATATACAAAACAA

SEQ ID NO: 32 - protein, 705 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 33 - protein, 3061 aa, Homo sapiens
GAGCGGGCGAGGGAGCGCGCGCGGCCGCCACAAAGCTCGGGCGCCGCGGGGCTGCATGCGGCGTACCTGGCCCGGCGCGGCGACTGCTCTCCGGGCTGGCGGGGGCCGGCCGCGAGCCCCGGGGGCCCCGAGGCCGCAGCTTGCCTGCGCGCTCTGAGCCTTCGCAACTCGCGAGCAAAGTTTGGTGGAGGCAACGCCAAGCCTGAGTCCTTTCTTCCTCTCGTTCCCCAAATCCGAGGGCAGCCCGCGGGCGTCATGCCCGCGCTCCTCCGCAGCCTGGGGTACGCGTGAAGCCCGGGAGGCTTGGCGCCGGCGAAGACCCAAGGACCACTCTTCTGCGTTTGGAGTTGCTCCCCGCAACCCCGGGCTCGTCGCTTTCTCCATCCCGACCCACGCGGGGCGCGGGGACAACACAGGTCGCGGAGGAGCGTTGCCATTCAAGTGACTGCAGCAGCAGCGGCAGCGCCTCGGTTCCTGAGCCCACCGCAGGCTGAAGGCATTGCGCGTAGTCCATGCCCGTAGAGGAAGTGTGCAGATGGGATTAACGTCCACATGGAGATATGGAAGAGGACCGGGGATTGGTACCGTAACCATGGTCAGCTGGGGTCGTTTCATCTGCCTGGTCGTGGTCACCATGGCAACCTTGTCCCTGGCCCGGCCCTCCTTCAGTTTAGTTGAGGATACCACATTAGAGCCAGAAGAGCCACCAACCAAATACCAAATCTCTCAACCAGAAGTGTACGTGGCTGCGCCAGGGGAGTCGCTAGAGGTGCGCTGCCTGTTGAAAGATGCCGCCGTGATCAGTTGGACTAAGGATGGGGTGCACTTGGGGCCCAACAATAGGACAGTGCTTATTGGGGAGTACTTGCAGATAAAGGGCGCCACGCCTAGAGACTCCGGCCTCTATGCTTGTACTGCCAGTAGGACTGTAGACAGTGAAACTTGGTACTTCATGGTGAATGTCACAGATGCCATCTCATCCGGAGATGATGAGGATGACACCGATGGTGCGGAAGATTTTGTCAGTGAGAACAGTAACAACAAGAGAGCACCATACTGGACCAACACAGAAAAGATGGAAAAGCGGCTCCATGCTGTGCCTGCGGCCAACACTGTCAAGTTTCGCTGCCCAGCCGGGGGGAACCCAATGCCAACCATGCGGTGGCTGAAAAACGGGAAGGAGTTTAAGCAGGAGCATCGCATTGGAGGCTACAAGGTACGAAACCAGCACTGGAGCCTCATTATGGAAAGTGTGGTCCCATCTGACAAGGGAAATTATACCTGTGTAGTGGAGAATGAATACGGGTCCATCAATCACACGTACCACCTGGATGTTGTGGAGCGATCGCCTCACCGGCCCATCCTCCAAGCCGGACTGCCGGCAAATGCCTCCACAGTGGTCGGAGGAGACGTAGAGTTTGTCTGCAAGGTTTACAGTGATGCCCAGCCCCACATCCAGTGGATCAAGCACGTGGAAAAGAACGGCAGTAAATACGGGCCCGACGGGCTGCCCTACCTCAAGGTTCTCAAGCACTCGGGGATAAATAGTTCCAATGCAGAAGTGCTGGCTCTGTTCAATGTGACCGAGGCGGATGCTGGGGAATATATATGTAAGGTCTCCAATTATATAGGGCAGGCCAACCAGTCTGCCTGGCTCACTGTCCTGCCAAAACAGCAAGCGCCTGGAAGAGAAAAGGAGATTACAGCTTCCCCAGACTACCTGGAGATAGCCATTTACTGCATAGGGGTCTTCTTAATCGCCTGTATGGTGGTAACAGTCATCCTGTGCCGAATGAAGAACACGACCAAGAAGCCAGACTTCAGCAGCCAGCCGGCTGTGCACAAGCTGACCAAACGTATCCCCCTGCGGAGACAGGTAACAGTTTCGGCTGAGTCCAGCTCCTCCATGAACTCCAACACCCCGCTGGTGAGGATAACAACACGCCTCTCTTCAACGGCAGACACCCCCATGCTGGCAGGGGTCTCCGAGTATGAACTTCCAGAGGACCCAAAATGGGAGTTTCCAAGAGATAAGCTGACACTGGGCAAGCCCCTGGGAGAAGGTTGCTTTGGGCAAGTGGTCATGGCGGAAGCAGTGGGAATTGACAAAGACAAGCCCAAGGAGGCGGTCACCGTGGCCGTGAAGATGTTGAAAGATGATGCCACAGAGAAAGACCTTTCTGATCTGGTGTCAGAGATGGAGATGATGAAGATGATTGGGAAACACAAGAATATCATAAATCTTCTTGGAGCCTGCACACAGGATGGGCCTCTCTATGTCATAGTTGAGTATGCCTCTAAAGGCAACCTCCGAGAATACCTCCGAGCCCGGAGGCCACCCGGGATGGAGTACTCCTATGACATTAACCGTGTTCCTGAGGAGCAGATGACCTTCAAGGACTTGGTGTCATGCACCTACCAGCTGGCCAGAGGCATGGAGTACTTGGCTTCCCAAAAATGTATTCATCGAGATTTAGCAGCCAGAAATGTTTTGGTAACAGAAAACAATGTGATGAAAATAGCAGACTTTGGACTCGCCAGAGATATCAACAATATAGACTATTACAAAAAGACCACCAATGGGCGGCTTCCAGTCAAGTGGATGGCTCCAGAAGCCCTGTTTGATAGAGTATACACTCATCAGAGTGATGTCTGGTCCTTCGGGGTGTTAATGTGGGAGATCTTCACTTTAGGGGGCTCGCCCTACCCAGGGATTCCCGTGGAGGAACTTTTTAAGCTGCTGAAGGAAGGACACAGAATGGATAAGCCAGCCAACTGCACCAACGAACTGTACATGATGATGAGGGACTGTTGGCATGCAGTGCCCTCCCAGAGACCAACGTTCAAGCAGTTGGTAGAAGACTTGGATCGAATTCTCACTCTCACAACCAATGAGGAATACTTGGACCTCAGCCAACCTCTCGAACAGTATTCACCTAGTTACCCTGACACAAGAAGTTCTTGTTCTTCAGGAGATGATTCTGTTTTTTCTCCAGACCCCATGCCTTACGAACCATGCCTTCCTCAGTATCCACACATAAACGGCAGTGTTAAAACATGA

SEQ ID NO: 34 - protein, 822 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 35 - protein, 3001 aa, Homo sapiens
GAGAGCCGAGCGGGCGGGCGGCGGGTGCGGAGCGGGCGAGGGAGCGCGCGCGGCCGCCACAAAGCTCGGGCGCCGCGGGGCTGCATGCGGCGTACCTGGCCCGGCGCGGCGACTGCTCTCCGGGCTGGCGGGGGCCGGCCGCGAGCCCCGGGGGCCCCGAGGCCGCAGCTTGCCTGCGCGCTCTGAGCCTTCGCAACTCGCGAGCAAAGTTTGGTGGAGGCAACGCCAAGCCTGAGTCCTTTCTTCCTCTCGTTCCCCAAATCCGAGGGCAGCCCGCGGGCGTCATGCCCGCGCTCCTCCGCAGCCTGGGGTACGCGTGAAGCCCGGGAGGCTTGGCGCCGGCGAAGACCCAAGGACCACTCTTCTGCGTTTGGAGTTGCTCCCCGCAACCCCGGGCTCGTCGCTTTCTCCATCCCGACCCACGCGGGGCGCGGGGACAACACAGGTCGCGGAGGAGCGTTGCCATTCAAGTGACTGCAGCAGCAGCGGCAGCGCCTCGGTTCCTGAGCCCACCGCAGGCTGAAGGCATTGCGCGTAGTCCATGCCCGTAGAGGAAGTGTGCAGATGGGATTAACGTCCACATGGAGATATGGAAGAGGACCGGGGATTGGTACCGTAACCATGGTCAGCTGGGGTCGTTTCATCTGCCTGGTCGTGGTCACCATGGCAACCTTGTCCCTGGCCCGGCCCTCCTTCAGTTTAGTTGAGGATACCACATTAGAGCCAGAAGATGCCATCTCATCCGGAGATGATGAGGATGACACCGATGGTGCGGAAGATTTTGTCAGTGAGAACAGTAACAACAAGAGAGCACCATACTGGACCAACACAGAAAAGATGGAAAAGCGGCTCCATGCTGTGCCTGCGGCCAACACTGTCAAGTTTCGCTGCCCAGCCGGGGGGAACCCAATGCCAACCATGCGGTGGCTGAAAAACGGGAAGGAGTTTAAGCAGGAGCATCGCATTGGAGGCTACAAGGTACGAAACCAGCACTGGAGCCTCATTATGGAAAGTGTGGTCCCATCTGACAAGGGAAATTATACCTGTGTAGTGGAGAATGAATACGGGTCCATCAATCACACGTACCACCTGGATGTTGTGGAGCGATCGCCTCACCGGCCCATCCTCCAAGCCGGACTGCCGGCAAATGCCTCCACAGTGGTCGGAGGAGACGTAGAGTTTGTCTGCAAGGTTTACAGTGATGCCCAGCCCCACATCCAGTGGATCAAGCACGTGGAAAAGAACGGCAGTAAATACGGGCCCGACGGGCTGCCCTACCTCAAGGTTCTCAAGCACTCGGGGATAAATAGTTCCAATGCAGAAGTGCTGGCTCTGTTCAATGTGACCGAGGCGGATGCTGGGGAATATATATGTAAGGTCTCCAATTATATAGGGCAGGCCAACCAGTCTGCCTGGCTCACTGTCCTGCCAAAACAGCAAGCGCCTGGAAGAGAAAAGGAGATTACAGCTTCCCCAGACTACCTGGAGATAGCCATTTACTGCATAGGGGTCTTCTTAATCGCCTGTATGGTGGTAACAGTCATCCTGTGCCGAATGAAGAACACGACCAAGAAGCCAGACTTCAGCAGCCAGCCGGCTGTGCACAAGCTGACCAAACGTATCCCCCTGCGGAGACAGGTAACAGTTTCGGCTGAGTCCAGCTCCTCCATGAACTCCAACACCCCGCTGGTGAGGATAACAACACGCCTCTCTTCAACGGCAGACACCCCCATGCTGGCAGGGGTCTCCGAGTATGAACTTCCAGAGGACCCAAAATGGGAGTTTCCAAGAGATAAGCTGACACTGGGCAAGCCCCTGGGAGAAGGTTGCTTTGGGCAAGTGGTCATGGCGGAAGCAGTGGGAATTGACAAAGACAAGCCCAAGGAGGCGGTCACCGTGGCCGTGAAGATGTTGAAAGATGATGCCACAGAGAAAGACCTTTCTGATCTGGTGTCAGAGATGGAGATGATGAAGATGATTGGGAAACACAAGAATATCATAAATCTTCTTGGAGCCTGCACACAGGATGGGCCTCTCTATGTCATAGTTGAGTATGCCTCTAAAGGCAACCTCCGAGAATACCTCCGAGCCCGGAGGCCACCCGGGATGGAGTACTCCTATGACATTAACCGTGTTCCTGAGGAGCAGATGACCTTCAAGGACTTGGTGTCATGCACCTACCAGCTGGCCAGAGGCATGGAGTACTTGGCTTCCCAAAAATGTATTCATCGAGATTTAGCAGCCAGAAATGTTTTGGTAACAGAAAACAATGTGATGAAAATAGCAGACTTTGGACTCGCCAGAGATATCAACAATATAGACTATTACAAAAAGACCACCAATGGGCGGCTTCCAGTCAAGTGGATGGCTCCAGAAGCCCTGTTTGATAGAGTATACACTCATCAGAGTGATGTCTGGTCCTTCGGGGTGTTAATGTGGGAGATCTTCACTTTAGGGGGCTCGCCCTACCCAGGGATTCCCGTGGAGGAACTTTTTAAGCTGCTGAAGGAAGGACACAGAATGGATAAGCCAGCCAACTGCACCAACGAACTGTACATGATGATGAGGGACTGTTGGCATGCAGTGCCCTCCCAGAGACCAACGTTCAAGCAGTTGGTAGAAGACTTGGATCGAATTCTCACTCTCACAACCAATGAGATCTGAAAGTTTATGGCTTCATTGAGAAACTGGGAAAAGTTGGTCAGGCGCAGTGGCTCATGCCTGTAATCCCAGCACTTTGGGAGGCCGAGGCAGGCGGATCATGAGGTCAGGAGTTCCAGACCAGCCTGGCCAACATGGTGAAACCCTGTCTCTACTAAAGATACAAAAAATTAGCCGGGCGTGTTGGTGTGCACCTGTAATCCCAGCTACTCCGGGAGGCTGAGGCAGGAGAGTCACTTGAACCGGGGAGGCGGAGGTTGCAGTGAGCCGAGATCATGCCATTGCATTCCAGCCTTGGCGACAGAGCGAGACTCCGTCTCAAAAAAAAAAAAAATAAAAA

SEQ ID NO: 36 - protein, 680 aa, Homo sapiens
MVSWGRFICLVVVTMATLSLARPSFSLVEDTTLEPEDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEI

SEQ ID NO: 37 - protein, 2650 aa, Homo sapiens
GGACCGGGGATTGGTACCGTAACCATGGTCAGCTGGGGTCGTTTCATCTGCCTGGTCGTGGTCACCATGGCAACCTTGTCCCTGGCCCGGCCCTCCTTCAGTTTAGTTGAGGATACCACATTAGAGCCAGAAGAGCCACCAACCAAATACCAAATCTCTCAACCAGAAGTGTACGTGGCTGCGCCAGGGGAGTCGCTAGAGGTGCGCTGCCTGTTGAAAGATGCCGCCGTGATCAGTTGGACTAAGGATGGGGTGCACTTGGGGCCCAACAATAGGACAGTGCTTATTGGGGAGTACTTGCAGATAAAGGGCGCCACGCCTAGAGACTCCGGCCTCTATGCTTGTACTGCCAGTAGGACTGTAGACAGTGAAACTTGGTACTTCATGGTGAATGTCACAGATGCCATCTCATCCGGAGATGATGAGGATGACACCGATGGTGCGGAAGATTTTGTCAGTGAGAACAGTAACAACAAGAGAGCACCATACTGGACCAACACAGAAAAGATGGAAAAGCGGCTCCATGCTGTGCCTGCGGCCAACACTGTCAAGTTTCGCTGCCCAGCCGGGGGGAACCCAATGCCAACCATGCGGTGGCTGAAAAACGGGAAGGAGTTTAAGCAGGAGCATCGCATTGGAGGCTACAAGGTACGAAACCAGCACTGGAGCCTCATTATGGAAAGTGTGGTCCCATCTGACAAGGGAAATTATACCTGTGTAGTGGAGAATGAATACGGGTCCATCAATCACACGTACCACCTGGATGTTGTGGAGCGATCGCCTCACCGGCCCATCCTCCAAGCCGGACTGCCGGCAAATGCCTCCACAGTGGTCGGAGGAGACGTAGAGTTTGTCTGCAAGGTTTACAGTGATGCCCAGCCCCACATCCAGTGGATCAAGCACGTGGAAAAGAACGGCAGTAAATACGGGCCCGACGGGCTGCCCTACCTCAAGGTTCTCAAGCACTCGGGGATAAATAGTTCCAATGCAGAAGTGCTGGCTCTGTTCAATGTGACCGAGGCGGATGCTGGGGAATATATATGTAAGGTCTCCAATTATATAGGGCAGGCCAACCAGTCTGCCTGGCTCACTGTCCTGCCAAAACAGCAAGCGCCTGGAAGAGAAAAGGAGATTACAGCTTCCCCAGACTACCTGGAGATAGCCATTTACTGCATAGGGGTCTTCTTAATCGCCTGTATGGTGGTAACAGTCATCCTGTGCCGAATGAAGAACACGACCAAGAAGCCAGACTTCAGCAGCCAGCCGGCTGTGCACAAGCTGACCAAACGTATCCCCCTGCGGAGACAGGTAACAGTTTCGGCTGAGTCCAGCTCCTCCATGAACTCCAACACCCCGCTGGTGAGGATAACAACACGCCTCTCTTCAACGGCAGACACCCCCATGCTGGCAGGGGTCTCCGAGTATGAACTTCCAGAGGACCCAAAATGGGAGTTTCCAAGAGATAAGCTGACACTGGGCAAGCCCCTGGGAGAAGGTTGCTTTGGGCAAGTGGTCATGGCGGAAGCAGTGGGAATTGACAAAGACAAGCCCAAGGAGGCGGTCACCGTGGCCGTGAAGATGTTGAAAGATGATGCCACAGAGAAAGACCTTTCTGATCTGGTGTCAGAGATGGAGATGATGAAGATGATTGGGAAACACAAGAATATCATAAATCTTCTTGGAGCCTGCACACAGGATGGGCCTCTCTATGTCATAGTTGAGTATGCCTCTAAAGGCAACCTCCGAGAATACCTCCGAGCCCGGAGGCCACCCGGGATGGAGTACTCCTATGACATTAACCGTGTTCCTGAGGAGCAGATGACCTTCAAGGACTTGGTGTCATGCACCTACCAGCTGGCCAGAGGCATGGAGTACTTGGCTTCCCAAAAATGTATTCATCGAGATTTAGCAGCCAGAAATGTTTTGGTAACAGAAAACAATGTGATGAAAATAGCAGACTTTGGACTCGCCAGAGATATCAACAATATAGACTATTACAAAAAGACCACCAATGGGCGGCTTCCAGTCAAGTGGATGGCTCCAGAAGCCCTGTTTGATAGAGTATACACTCATCAGAGTGATGTCTGGTCCTTCGGGGTGTTAATGTGGGAGATCTTCACTTTAGGGGGCTCGCCCTACCCAGGGATTCCCGTGGAGGAACTTTTTAAGCTGCTGAAGGAAGGACACAGAATGGATAAGCCAGCCAACTGCACCAACGAACTGTACATGATGATGAGGGACTGTTGGCATGCAGTGCCCTCCCAGAGACCAACGTTCAAGCAGTTGGTAGAAGACTTGGATCGAATTCTCACTCTCACAACCAATGAGATCTGAAAGTTTATGGCTTCATTGAGAAACTGGGAAAAGTTGGTCAGGCGCAGTGGCTCATGCCTGTAATCCCAGCACTTTGGGAGGCCGAGGCAGGCGGATCATGAGGTCAGGAGTTCCAGACCAGCCTGGCCAACATGGTGAAACCCTGTCTCTACTAAAGATACAAAAAATTAGCCGGGCGTGTTGGTGTGCACCTGTAATCCCAGCTACTCCGGGAGGCTGAGGCAGGAGAGTCACTTGAACCGGGGAGGCGGAGGTTGCAGTGAGCCGAGATCATGCCATTGCATTCCAGCCTTGGCGACAGAGCGAGACTCCGTCT

SEQ ID NO: 38 - protein, 769 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKHSGINSSNAEVLALFNVTEADAGEYICKVSNYIGQANQSAWLTVLPKQQAPGREKEITASPDYLEIAIYCIGVFLIACMVVTVILCRMKNTTKKPDFSSQPAVHKLTKRIPLRRQVTVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEI

SEQ ID NO: 39 - protein, 2472 aa, Homo sapiens
GGTACCGTAACCATGGTCAGCTGGGGTCGTTTCATCTGCCTGGTCGTGGTCACCATGGCAACCTTGTCCCTGGCCCGGCCCTCCTTCAGTTTAGTTGAGGATACCACATTAGAGCCAGAAGAGCCACCAACCAAATACCAAATCTCTCAACCAGAAGTGTACGTGGCTGCGCCAGGGGAGTCGCTAGAGGTGCGCTGCCTGTTGAAAGATGCCGCCGTGATCAGTTGGACTAAGGATGGGGTGCACTTGGGGCCCAACAATAGGACAGTGCTTATTGGGGAGTACTTGCAGATAAAGGGCGCCACGCCTAGAGACTCCGGCCTCTATGCTTGTACTGCCAGTAGGACTGTAGACAGTGAAACTTGGTACTTCATGGTGAATGTCACAGATGCCATCTCATCCGGAGATGATGAGGATGACACCGATGGTGCGGAAGATTTTGTCAGTGAGAACAGTAACAACAAGAGAGCACCATACTGGACCAACACAGAAAAGATGGAAAAGCGGCTCCATGCTGTGCCTGCGGCCAACACTGTCAAGTTTCGCTGCCCAGCCGGGGGGAACCCAATGCCAACCATGCGGTGGCTGAAAAACGGGAAGGAGTTTAAGCAGGAGCATCGCATTGGAGGCTACAAGGTACGAAACCAGCACTGGAGCCTCATTATGGAAAGTGTGGTCCCATCTGACAAGGGAAATTATACCTGTGTAGTGGAGAATGAATACGGGTCCATCAATCACACGTACCACCTGGATGTTGTGGAGCGATCGCCTCACCGGCCCATCCTCCAAGCCGGACTGCCGGCAAATGCCTCCACAGTGGTCGGAGGAGACGTAGAGTTTGTCTGCAAGGTTTACAGTGATGCCCAGCCCCACATCCAGTGGATCAAGCACGTGGAAAAGAACGGCAGTAAATACGGGCCCGACGGGCTGCCCTACCTCAAGGTTCTCAAGGCCGCCGGTGTTAACACCACGGACAAAGAGATTGAGGTTCTCTATATTCGGAATGTAACTTTTGAGGACGCTGGGGAATATACGTGCTTGGCGGGTAATTCTATTGGGATATCCTTTCACTCTGCATGGTTGACAGTTCTGCCAGCGCCTGGAAGAGAAAAGGAGATTACAGCTTCCCCAGACTACCTGGAGATAGCCATTTACTGCATAGGGGTCTTCTTAATCGCCTGTATGGTGGTAACAGTCATCCTGTGCCGAATGAAGAACACGACCAAGAAGCCAGACTTCAGCAGCCAGCCGGCTGTGCACAAGCTGACCAAACGTATCCCCCTGCGGAGACAGGTTTCGGCTGAGTCCAGCTCCTCCATGAACTCCAACACCCCGCTGGTGAGGATAACAACACGCCTCTCTTCAACGGCAGACACCCCCATGCTGGCAGGGGTCTCCGAGTATGAACTTCCAGAGGACCCAAAATGGGAGTTTCCAAGAGATAAGCTGACACTGGGCAAGCCCCTGGGAGAAGGTTGCTTTGGGCAAGTGGTCATGGCGGAAGCAGTGGGAATTGACAAAGACAAGCCCAAGGAGGCGGTCACCGTGGCCGTGAAGATGTTGAAAGATGATGCCACAGAGAAAGACCTTTCTGATCTGGTGTCAGAGATGGAGATGATGAAGATGATTGGGAAACACAAGAATATCATAAATCTTCTTGGAGCCTGCACACAGGATGGGCCTCTCTATGTCATAGTTGAGTATGCCTCTAAAGGCAACCTCCGAGAATACCTCCGAGCCCGGAGGCCACCCGGGATGGAGTACTCCTATGACATTAACCGTGTTCCTGAGGAGCAGATGACCTTCAAGGACTTGGTGTCATGCACCTACCAGCTGGCCAGAGGCATGGAGTACTTGGCTTCCCAAAAATGTATTCATCGAGATTTAGCAGCCAGAAATGTTTTGGTAACAGAAAACAATGTGATGAAAATAGCAGACTTTGGACTCGCCAGAGATATCAACAATATAGACTATTACAAAAAGACCACCAATGGGCGGCTTCCAGTCAAGTGGATGGCTCCAGAAGCCCTGTTTGATAGAGTATACACTCATCAGAGTGATGTCTGGTCCTTCGGGGTGTTAATGTGGGAGATCTTCACTTTAGGGGGCTCGCCCTACCCAGGGATTCCCGTGGAGGAACTTTTTAAGCTGCTGAAGGAAGGACACAGAATGGATAAGCCAGCCAACTGCACCAACGAACTGTACATGATGATGAGGGACTGTTGGCATGCAGTGCCCTCCCAGAGACCAACGTTCAAGCAGTTGGTAGAAGACTTGGATCGAATTCTCACTCTCACAACCAATGAGGAATACTTGGACCTCAGCCAACCTCTCGAACAGTATTCACCTAGTTACCCTGACACAAGAAGTTCTTGTTCTTCAGGAGATGATTCTGTTTTTTCTCCAGACCCCATGCCTTACGAACCATGCCTTCCTCAGTATCCACACATAAACGGCAGTGTTAAAACATGA

SEQ ID NO: 40 - protein, 819 aa, Homo sapiens
MVSWGRFICLVVVTMATLSLARPSFSLVEDTTLEPEEPPTKYQISQPEVYVAAPGESLEVRCLLKDAAVISWTKDGVHLGPNNRTVLIGEYLQIKGATPRDSGLYACTASRTVDSETWYFMVNVTDAISSGDDEDDTDGAEDFVSENSNNKRAPYWTNTEKMEKRLHAVPAANTVKFRCPAGGNPMPTMRWLKNGKEFKQEHRIGGYKVRNQHWSLIMESVVPSDKGNYTCVVENEYGSINHTYHLDVVERSPHRPILQAGLPANASTVVGGDVEFVCKVYSDAQPHIQWIKHVEKNGSKYGPDGLPYLKVLKAAGVNTTDKEIEVLYIRNVTFEDAGEYTCLAGNSIGISFHSAWLTVLPAPGREKEITASPDYLEIAIYCIGVFLIACMVVTVILCRMKNTTKKPDFSSQPAVHKLTKRIPLRRQVSAESSSSMNSNTPLVRITTRLSSTADTPMLAGVSEYELPEDPKWEFPRDKLTLGKPLGEGCFGQVVMAEAVGIDKDKPKEAVTVAVKMLKDDATEKDLSDLVSEMEMMKMIGKHKNIINLLGACTQDGPLYVIVEYASKGNLREYLRARRPPGMEYSYDINRVPEEQMTFKDLVSCTYQLARGMEYLASQKCIHRDLAARNVLVTENNVMKIADFGLARDINNIDYYKKTTNGRLPVKWMAPEALFDRVYTHQSDVWSFGVLMWEIFTLGGSPYPGIPVEELFKLLKEGHRMDKPANCTNELYMMMRDCWHAVPSQRPTFKQLVEDLDRILTLTTNEEYLDLSQPLEQYSPSYPDTRSSCSSGDDSVFSPDPMPYEPCLPQYPHINGSVKT

SEQ ID NO: 41 - protein, 4306 aa, Homo sapiens
AGTGCGCGGTGGCGGCGGCGTCGCGGGCAGCTGGCGCCGCGCGGTCCTGCTCTGCCGGTCGCACGGACGCACCGGCGGGCCGCCGGCCGGAGGGACGGGGCGGGAGCTGGGCCCGCGGACAGCGAGCCGGAGCGGGAGCCGCGCGTAGCGAGCCGGGCTCCGGCGCTCGCCAGTCTCCCGAGCGGCGCCCGCCTCCCGCCGGTGCCCGCGCCGGGCCGTGGGGGGCAGCATGCCCGCGCGCGCTGCCTGAGGACGCCGCGGCCCCCGCCCCCGCCATGGGCGCCCCTGCCTGCGCCCTCGCGCTCTGCGTGGCCGTGGCCATCGTGGCCGGCGCCTCCTCGGAGTCCTTGGGGACGGAGCAGCGCGTCGTGGGGCGAGCGGCAGAAGTCCCGGGCCCAGAGCCCGGCCAGCAGGAGCAGTTGGTCTTCGGCAGCGGGGATGCTGTGGAGCTGAGCTGTCCCCCGCCCGGGGGTGGTCCCATGGGGCCCACTGTCTGGGTCAAGGATGGCACAGGGCTGGTGCCCTCGGAGCGTGTCCTGGTGGGGCCCCAGCGGCTGCAGGTGCTGAATGCCTCCCACGAGGACTCCGGGGCCTACAGCTGCCGGCAGCGGCTCACGCAGCGCGTACTGTGCCACTTCAGTGTGCGGGTGACAGACGCTCCATCCTCGGGAGATGACGAAGACGGGGAGGACGAGGCTGAGGACACAGGTGTGGACACAGGGGCCCCTTACTGGACACGGCCCGAGCGGATGGACAAGAAGCTGCTGGCCGTGCCGGCCGCCAACACCGTCCGCTTCCGCTGCCCAGCCGCTGGCAACCCCACTCCCTCCATCTCCTGGCTGAAGAACGGCAGGGAGTTCCGCGGCGAGCACCGCATTGGAGGCATCAAGCTGCGGCATCAGCAGTGGAGCCTGGTCATGGAAAGCGTGGTGCCCTCGGACCGCGGCAACTACACCTGCGTCGTGGAGAACAAGTTTGGCAGCATCCGGCAGACGTACACGCTGGACGTGCTGGAGCGCTCCCCGCACCGGCCCATCCTGCAGGCGGGGCTGCCGGCCAACCAGACGGCGGTGCTGGGCAGCGACGTGGAGTTCCACTGCAAGGTGTACAGTGACGCACAGCCCCACATCCAGTGGCTCAAGCACGTGGAGGTGAATGGCAGCAAGGTGGGCCCGGACGGCACACCCTACGTTACCGTGCTCAAGACGGCGGGCGCTAACACCACCGACAAGGAGCTAGAGGTTCTCTCCTTGCACAACGTCACCTTTGAGGACGCCGGGGAGTACACCTGCCTGGCGGGCAATTCTATTGGGTTTTCTCATCACTCTGCGTGGCTGGTGGTGCTGCCAGCCGAGGAGGAGCTGGTGGAGGCTGACGAGGCGGGCAGTGTGTATGCAGGCATCCTCAGCTACGGGGTGGGCTTCTTCCTGTTCATCCTGGTGGTGGCGGCTGTGACGCTCTGCCGCCTGCGCAGCCCCCCCAAGAAAGGCCTGGGCTCCCCCACCGTGCACAAGATCTCCCGCTTCCCGCTCAAGCGACAGGTGTCCCTGGAGTCCAACGCGTCCATGAGCTCCAACACACCACTGGTGCGCATCGCAAGGCTGTCCTCAGGGGAGGGCCCCACGCTGGCCAATGTCTCCGAGCTCGAGCTGCCTGCCGACCCCAAATGGGAGCTGTCTCGGGCCCGGCTGACCCTGGGCAAGCCCCTTGGGGAGGGCTGCTTCGGCCAGGTGGTCATGGCGGAGGCCATCGGCATTGACAAGGACCGGGCCGCCAAGCCTGTCACCGTAGCCGTGAAGATGCTGAAAGACGATGCCACTGACAAGGACCTGTCGGACCTGGTGTCTGAGATGGAGATGATGAAGATGATCGGGAAACACAAAAACATCATCAACCTGCTGGGCGCCTGCACGCAGGGCGGGCCCCTGTACGTGCTGGTGGAGTACGCGGCCAAGGGTAACCTGCGGGAGTTTCTGCGGGCGCGGCGGCCCCCGGGCCTGGACTACTCCTTCGACACCTGCAAGCCGCCCGAGGAGCAGCTCACCTTCAAGGACCTGGTGTCCTGTGCCTACCAGGTGGCCCGGGGCATGGAGTACTTGGCCTCCCAGAAGTGCATCCACAGGGACCTGGCTGCCCGCAATGTGCTGGTGACCGAGGACAACGTGATGAAGATCGCAGACTTCGGGCTGGCCCGGGACGTGCACAACCTCGACTACTACAAGAAGACGACCAACGGCCGGCTGCCCGTGAAGTGGATGGCGCCTGAGGCCTTGTTTGACCGAGTCTACACTCACCAGAGTGACGTCTGGTCCTTTGGGGTCCTGCTCTGGGAGATCTTCACGCTGGGGGGCTCCCCGTACCCCGGCATCCCTGTGGAGGAGCTCTTCAAGCTGCTGAAGGAGGGCCACCGCATGGACAAGCCCGCCAACTGCACACACGACCTGTACATGATCATGCGGGAGTGCTGGCATGCCGCGCCCTCCCAGAGGCCCACCTTCAAGCAGCTGGTGGAGGACCTGGACCGTGTCCTTACCGTGACGTCCACCGACGAGTACCTGGACCTGTCGGCGCCTTTCGAGCAGTACTCCCCGGGTGGCCAGGACACCCCCAGCTCCAGCTCCTCAGGGGACGACTCCGTGTTTGCCCACGACCTGCTGCCCCCGGCCCCACCCAGCAGTGGGGGCTCGCGGACGTGAAGGGCCACTGGTCCCCAACAATGTGAGGGGTCCCTAGCAGCCCACCCTGCTGCTGGTGCACAGCCACTCCCCGGCATGAGACTCAGTGCAGATGGAGAGACAGCTACACAGAGCTTTGGTCTGTGTGTGTGTGTGTGCGTGTGTGTGTGTGTGTGTGCACATCCGCGTGTGCCTGTGTGCGTGCGCATCTTGCCTCCAGGTGCAGAGGTACCCTGGGTGTCCCCGCTGCTGTGCAACGGTCTCCTGACTGGTGCTGCAGCACCGAGGGGCCTTTGTTCTGGGGGGACCCAGTGCAGAATGTAAGTGGGCCCACCCGGTGGGACCCCCGTGGGGCAGGGAGCTGGGCCCGACATGGCTCCGGCCTCTGCCTTTGCACCACGGGACATCACAGGGTGGGCCTCGGCCCCTCCCACACCCAAAGCTGAGCCTGCAGGGAAGCCCCACATGTCCAGCACCTTGTGCCTGGGGTGTTAGTGGCACCGCCTCCCCACCTCCAGGCTTTCCCACTTCCCACCCTGCCCCTCAGAGACTGAAATTACGGGTACCTGAAGATGGGAGCCTTTACCTTTTATGCAAAAGGTTTATTCCGGAAACTAGTGTACATTTCTATAAATAGATGCTGTGTATATGGTATATATACATATATATATATAACATATATGGAAGAGGAAAAGGCTGGTACAACGGAGGCCTGCGACCCTGGGGGCACAGGAGGCAGGCATGGCCCTGGGCGGGGCGTGGGGGGGCGTGGAGGGAGGCCCCAGGGGGTCTCACCCATGCAAGCAGAGGACCAGGGCCTTTTCTGGCACCGCAGTTTTGTTTTAAAACTGGACCTGTATATTTGTAAAGCTATTTATGGGCCCCTGGCACTCTTGTTCCCACACCCCAACACTTCCAGCATTTAGCTGGCCACATGGCGGAGAGTTTTAATTTTTAACTTATTGACAACCGAGAAGGTTTATCCCGCCGATAGAGGGACGGCCAAGAATGTACGTCCAGCCTGCCCCGGAGCTGGAGGATCCCCTCCAAGCCTAAAAGGTTGTTAATAGTTGGAGGTGATTCCAGTGAAGATATTTTATTTCCTTTGTCCTTTTTCAGGAGAATTAGATTTCTATAGGATTTTTCTTTAGGAGATTTATTTTTTGGACTTCAAAGCAAGCTGGTATTTTCATACAAATTCTTCTAATTGCTGTGTGTCCCAGGCAGGGAGACGGTTTCCAGGGAGGGGCCGGCCCTGTGTGCAGGTTCCGATGTTATTAGATGTTACAAGTTTATATATATCTATATATATAATTTATTGAGTTTTTACAAGATGTATTTGTTGTAGACTTAACACTTCTTACGCAATGCTTCTAGAGTTTTATAGCCTGGACTGCTACCTTTCAAAGCTTGGAGGGAAGCCGTGAATTCAGTTGGTTCGTTCTGTACTGTTACTGGGCCCTGAGTCTGGGCAGCTGTCCCTTGCTTGCCTGCAGGGCCATGGCTCAGGGTGGTCTCTTCTTGGGGCCCAGTGCATGGTGGCCAGAGGTGTCACCCAAACCGGCAGGTGCGATTTTGTTAACCCAGCGACGAACTTTCCGAAAAATAAAGACACCTGGTTGCTAACCTGG

SEQ ID NO: 42 - protein, 806 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKTAGANTTDKELEVLSLHNVTFEDAGEYTCLAGNSIGFSHHSAWLVVLPAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 43 - protein, 4293 aa, Homo sapiens
GTCGCGGGCAGCTGGCGCCGCGCGGTCCTGCTCTGCCGGTCGCACGGACGCACCGGCGGGCCGCCGGCCGGAGGGACGGGGCGGGAGCTGGGCCCGCGGACAGCGAGCCGGAGCGGGAGCCGCGCGTAGCGAGCCGGGCTCCGGCGCTCGCCAGTCTCCCGAGCGGCGCCCGCCTCCCGCCGGTGCCCGCGCCGGGCCGTGGGGGGCAGCATGCCCGCGCGCGCTGCCTGAGGACGCCGCGGCCCCCGCCCCCGCCATGGGCGCCCCTGCCTGCGCCCTCGCGCTCTGCGTGGCCGTGGCCATCGTGGCCGGCGCCTCCTCGGAGTCCTTGGGGACGGAGCAGCGCGTCGTGGGGCGAGCGGCAGAAGTCCCGGGCCCAGAGCCCGGCCAGCAGGAGCAGTTGGTCTTCGGCAGCGGGGATGCTGTGGAGCTGAGCTGTCCCCCGCCCGGGGGTGGTCCCATGGGGCCCACTGTCTGGGTCAAGGATGGCACAGGGCTGGTGCCCTCGGAGCGTGTCCTGGTGGGGCCCCAGCGGCTGCAGGTGCTGAATGCCTCCCACGAGGACTCCGGGGCCTACAGCTGCCGGCAGCGGCTCACGCAGCGCGTACTGTGCCACTTCAGTGTGCGGGTGACAGACGCTCCATCCTCGGGAGATGACGAAGACGGGGAGGACGAGGCTGAGGACACAGGTGTGGACACAGGGGCCCCTTACTGGACACGGCCCGAGCGGATGGACAAGAAGCTGCTGGCCGTGCCGGCCGCCAACACCGTCCGCTTCCGCTGCCCAGCCGCTGGCAACCCCACTCCCTCCATCTCCTGGCTGAAGAACGGCAGGGAGTTCCGCGGCGAGCACCGCATTGGAGGCATCAAGCTGCGGCATCAGCAGTGGAGCCTGGTCATGGAAAGCGTGGTGCCCTCGGACCGCGGCAACTACACCTGCGTCGTGGAGAACAAGTTTGGCAGCATCCGGCAGACGTACACGCTGGACGTGCTGGAGCGCTCCCCGCACCGGCCCATCCTGCAGGCGGGGCTGCCGGCCAACCAGACGGCGGTGCTGGGCAGCGACGTGGAGTTCCACTGCAAGGTGTACAGTGACGCACAGCCCCACATCCAGTGGCTCAAGCACGTGGAGGTGAATGGCAGCAAGGTGGGCCCGGACGGCACACCCTACGTTACCGTGCTCAAGTCCTGGATCAGTGAGAGTGTGGAGGCCGACGTGCGCCTCCGCCTGGCCAATGTGTCGGAGCGGGACGGGGGCGAGTACCTCTGTCGAGCCACCAATTTCATAGGCGTGGCCGAGAAGGCCTTTTGGCTGAGCGTTCACGGGCCCCGAGCAGCCGAGGAGGAGCTGGTGGAGGCTGACGAGGCGGGCAGTGTGTATGCAGGCATCCTCAGCTACGGGGTGGGCTTCTTCCTGTTCATCCTGGTGGTGGCGGCTGTGACGCTCTGCCGCCTGCGCAGCCCCCCCAAGAAAGGCCTGGGCTCCCCCACCGTGCACAAGATCTCCCGCTTCCCGCTCAAGCGACAGGTGTCCCTGGAGTCCAACGCGTCCATGAGCTCCAACACACCACTGGTGCGCATCGCAAGGCTGTCCTCAGGGGAGGGCCCCACGCTGGCCAATGTCTCCGAGCTCGAGCTGCCTGCCGACCCCAAATGGGAGCTGTCTCGGGCCCGGCTGACCCTGGGCAAGCCCCTTGGGGAGGGCTGCTTCGGCCAGGTGGTCATGGCGGAGGCCATCGGCATTGACAAGGACCGGGCCGCCAAGCCTGTCACCGTAGCCGTGAAGATGCTGAAAGACGATGCCACTGACAAGGACCTGTCGGACCTGGTGTCTGAGATGGAGATGATGAAGATGATCGGGAAACACAAAAACATCATCAACCTGCTGGGCGCCTGCACGCAGGGCGGGCCCCTGTACGTGCTGGTGGAGTACGCGGCCAAGGGTAACCTGCGGGAGTTTCTGCGGGCGCGGCGGCCCCCGGGCCTGGACTACTCCTTCGACACCTGCAAGCCGCCCGAGGAGCAGCTCACCTTCAAGGACCTGGTGTCCTGTGCCTACCAGGTGGCCCGGGGCATGGAGTACTTGGCCTCCCAGAAGTGCATCCACAGGGACCTGGCTGCCCGCAATGTGCTGGTGACCGAGGACAACGTGATGAAGATCGCAGACTTCGGGCTGGCCCGGGACGTGCACAACCTCGACTACTACAAGAAGACGACCAACGGCCGGCTGCCCGTGAAGTGGATGGCGCCTGAGGCCTTGTTTGACCGAGTCTACACTCACCAGAGTGACGTCTGGTCCTTTGGGGTCCTGCTCTGGGAGATCTTCACGCTGGGGGGCTCCCCGTACCCCGGCATCCCTGTGGAGGAGCTCTTCAAGCTGCTGAAGGAGGGCCACCGCATGGACAAGCCCGCCAACTGCACACACGACCTGTACATGATCATGCGGGAGTGCTGGCATGCCGCGCCCTCCCAGAGGCCCACCTTCAAGCAGCTGGTGGAGGACCTGGACCGTGTCCTTACCGTGACGTCCACCGACGAGTACCTGGACCTGTCGGCGCCTTTCGAGCAGTACTCCCCGGGTGGCCAGGACACCCCCAGCTCCAGCTCCTCAGGGGACGACTCCGTGTTTGCCCACGACCTGCTGCCCCCGGCCCCACCCAGCAGTGGGGGCTCGCGGACGTGAAGGGCCACTGGTCCCCAACAATGTGAGGGGTCCCTAGCAGCCCACCCTGCTGCTGGTGCACAGCCACTCCCCGGCATGAGACTCAGTGCAGATGGAGAGACAGCTACACAGAGCTTTGGTCTGTGTGTGTGTGTGTGCGTGTGTGTGTGTGTGTGTGCACATCCGCGTGTGCCTGTGTGCGTGCGCATCTTGCCTCCAGGTGCAGAGGTACCCTGGGTGTCCCCGCTGCTGTGCAACGGTCTCCTGACTGGTGCTGCAGCACCGAGGGGCCTTTGTTCTGGGGGGACCCAGTGCAGAATGTAAGTGGGCCCACCCGGTGGGACCCCCGTGGGGCAGGGAGCTGGGCCCGACATGGCTCCGGCCTCTGCCTTTGCACCACGGGACATCACAGGGTGGGCCTCGGCCCCTCCCACACCCAAAGCTGAGCCTGCAGGGAAGCCCCACATGTCCAGCACCTTGTGCCTGGGGTGTTAGTGGCACCGCCTCCCCACCTCCAGGCTTTCCCACTTCCCACCCTGCCCCTCAGAGACTGAAATTACGGGTACCTGAAGATGGGAGCCTTTACCTTTTATGCAAAAGGTTTATTCCGGAAACTAGTGTACATTTCTATAAATAGATGCTGTGTATATGGTATATATACATATATATATATAACATATATGGAAGAGGAAAAGGCTGGTACAACGGAGGCCTGCGACCCTGGGGGCACAGGAGGCAGGCATGGCCCTGGGCGGGGCGTGGGGGGGCGTGGAGGGAGGCCCCAGGGGGTCTCACCCATGCAAGCAGAGGACCAGGGCCTTTTCTGGCACCGCAGTTTTGTTTTAAAACTGGACCTGTATATTTGTAAAGCTATTTATGGGCCCCTGGCACTCTTGTTCCCACACCCCAACACTTCCAGCATTTAGCTGGCCACATGGCGGAGAGTTTTAATTTTTAACTTATTGACAACCGAGAAGGTTTATCCCGCCGATAGAGGGACGGCCAAGAATGTACGTCCAGCCTGCCCCGGAGCTGGAGGATCCCCTCCAAGCCTAAAAGGTTGTTAATAGTTGGAGGTGATTCCAGTGAAGATATTTTATTTCCTTTGTCCTTTTTCAGGAGAATTAGATTTCTATAGGATTTTTCTTTAGGAGATTTATTTTTTGGACTTCAAAGCAAGCTGGTATTTTCATACAAATTCTTCTAATTGCTGTGTGTCCCAGGCAGGGAGACGGTTTCCAGGGAGGGGCCGGCCCTGTGTGCAGGTTCCGATGTTATTAGATGTTACAAGTTTATATATATCTATATATATAATTTATTGAGTTTTTACAAGATGTATTTGTTGTAGACTTAACACTTCTTACGCAATGCTTCTAGAGTTTTATAGCCTGGACTGCTACCTTTCAAAGCTTGGAGGGAAGCCGTGAATTCAGTTGGTTCGTTCTGTACTGTTACTGGGCCCTGAGTCTGGGCAGCTGTCCCTTGCTTGCCTGCAGGGCCATGGCTCAGGGTGGTCTCTTCTTGGGGCCCAGTGCATGGTGGCCAGAGGTGTCACCCAAACCGGCAGGTGCGATTTTGTTAACCCAGCGACGAACTTTCCGAAAAATAAAGACACCTGGTTGCTAACCTGG

SEQ ID NO: 44 - protein, 808 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKSWISESVEADVRLRLANVSERDGGEYLCRATNFIGVAEKAFWLSVHGPRAAEEELVEADEAGSVYAGILSYGVGFFLFILVVAAVTLCRLRSPPKKGLGSPTVHKISRFPLKRQVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 45 - protein, 3951 aa, Homo sapiens
GTCGCGGGCAGCTGGCGCCGCGCGGTCCTGCTCTGCCGGTCGCACGGACGCACCGGCGGGCCGCCGGCCGGAGGGACGGGGCGGGAGCTGGGCCCGCGGACAGCGAGCCGGAGCGGGAGCCGCGCGTAGCGAGCCGGGCTCCGGCGCTCGCCAGTCTCCCGAGCGGCGCCCGCCTCCCGCCGGTGCCCGCGCCGGGCCGTGGGGGGCAGCATGCCCGCGCGCGCTGCCTGAGGACGCCGCGGCCCCCGCCCCCGCCATGGGCGCCCCTGCCTGCGCCCTCGCGCTCTGCGTGGCCGTGGCCATCGTGGCCGGCGCCTCCTCGGAGTCCTTGGGGACGGAGCAGCGCGTCGTGGGGCGAGCGGCAGAAGTCCCGGGCCCAGAGCCCGGCCAGCAGGAGCAGTTGGTCTTCGGCAGCGGGGATGCTGTGGAGCTGAGCTGTCCCCCGCCCGGGGGTGGTCCCATGGGGCCCACTGTCTGGGTCAAGGATGGCACAGGGCTGGTGCCCTCGGAGCGTGTCCTGGTGGGGCCCCAGCGGCTGCAGGTGCTGAATGCCTCCCACGAGGACTCCGGGGCCTACAGCTGCCGGCAGCGGCTCACGCAGCGCGTACTGTGCCACTTCAGTGTGCGGGTGACAGACGCTCCATCCTCGGGAGATGACGAAGACGGGGAGGACGAGGCTGAGGACACAGGTGTGGACACAGGGGCCCCTTACTGGACACGGCCCGAGCGGATGGACAAGAAGCTGCTGGCCGTGCCGGCCGCCAACACCGTCCGCTTCCGCTGCCCAGCCGCTGGCAACCCCACTCCCTCCATCTCCTGGCTGAAGAACGGCAGGGAGTTCCGCGGCGAGCACCGCATTGGAGGCATCAAGCTGCGGCATCAGCAGTGGAGCCTGGTCATGGAAAGCGTGGTGCCCTCGGACCGCGGCAACTACACCTGCGTCGTGGAGAACAAGTTTGGCAGCATCCGGCAGACGTACACGCTGGACGTGCTGGAGCGCTCCCCGCACCGGCCCATCCTGCAGGCGGGGCTGCCGGCCAACCAGACGGCGGTGCTGGGCAGCGACGTGGAGTTCCACTGCAAGGTGTACAGTGACGCACAGCCCCACATCCAGTGGCTCAAGCACGTGGAGGTGAATGGCAGCAAGGTGGGCCCGGACGGCACACCCTACGTTACCGTGCTCAAGGTGTCCCTGGAGTCCAACGCGTCCATGAGCTCCAACACACCACTGGTGCGCATCGCAAGGCTGTCCTCAGGGGAGGGCCCCACGCTGGCCAATGTCTCCGAGCTCGAGCTGCCTGCCGACCCCAAATGGGAGCTGTCTCGGGCCCGGCTGACCCTGGGCAAGCCCCTTGGGGAGGGCTGCTTCGGCCAGGTGGTCATGGCGGAGGCCATCGGCATTGACAAGGACCGGGCCGCCAAGCCTGTCACCGTAGCCGTGAAGATGCTGAAAGACGATGCCACTGACAAGGACCTGTCGGACCTGGTGTCTGAGATGGAGATGATGAAGATGATCGGGAAACACAAAAACATCATCAACCTGCTGGGCGCCTGCACGCAGGGCGGGCCCCTGTACGTGCTGGTGGAGTACGCGGCCAAGGGTAACCTGCGGGAGTTTCTGCGGGCGCGGCGGCCCCCGGGCCTGGACTACTCCTTCGACACCTGCAAGCCGCCCGAGGAGCAGCTCACCTTCAAGGACCTGGTGTCCTGTGCCTACCAGGTGGCCCGGGGCATGGAGTACTTGGCCTCCCAGAAGTGCATCCACAGGGACCTGGCTGCCCGCAATGTGCTGGTGACCGAGGACAACGTGATGAAGATCGCAGACTTCGGGCTGGCCCGGGACGTGCACAACCTCGACTACTACAAGAAGACGACCAACGGCCGGCTGCCCGTGAAGTGGATGGCGCCTGAGGCCTTGTTTGACCGAGTCTACACTCACCAGAGTGACGTCTGGTCCTTTGGGGTCCTGCTCTGGGAGATCTTCACGCTGGGGGGCTCCCCGTACCCCGGCATCCCTGTGGAGGAGCTCTTCAAGCTGCTGAAGGAGGGCCACCGCATGGACAAGCCCGCCAACTGCACACACGACCTGTACATGATCATGCGGGAGTGCTGGCATGCCGCGCCCTCCCAGAGGCCCACCTTCAAGCAGCTGGTGGAGGACCTGGACCGTGTCCTTACCGTGACGTCCACCGACGAGTACCTGGACCTGTCGGCGCCTTTCGAGCAGTACTCCCCGGGTGGCCAGGACACCCCCAGCTCCAGCTCCTCAGGGGACGACTCCGTGTTTGCCCACGACCTGCTGCCCCCGGCCCCACCCAGCAGTGGGGGCTCGCGGACGTGAAGGGCCACTGGTCCCCAACAATGTGAGGGGTCCCTAGCAGCCCACCCTGCTGCTGGTGCACAGCCACTCCCCGGCATGAGACTCAGTGCAGATGGAGAGACAGCTACACAGAGCTTTGGTCTGTGTGTGTGTGTGTGCGTGTGTGTGTGTGTGTGTGCACATCCGCGTGTGCCTGTGTGCGTGCGCATCTTGCCTCCAGGTGCAGAGGTACCCTGGGTGTCCCCGCTGCTGTGCAACGGTCTCCTGACTGGTGCTGCAGCACCGAGGGGCCTTTGTTCTGGGGGGACCCAGTGCAGAATGTAAGTGGGCCCACCCGGTGGGACCCCCGTGGGGCAGGGAGCTGGGCCCGACATGGCTCCGGCCTCTGCCTTTGCACCACGGGACATCACAGGGTGGGCCTCGGCCCCTCCCACACCCAAAGCTGAGCCTGCAGGGAAGCCCCACATGTCCAGCACCTTGTGCCTGGGGTGTTAGTGGCACCGCCTCCCCACCTCCAGGCTTTCCCACTTCCCACCCTGCCCCTCAGAGACTGAAATTACGGGTACCTGAAGATGGGAGCCTTTACCTTTTATGCAAAAGGTTTATTCCGGAAACTAGTGTACATTTCTATAAATAGATGCTGTGTATATGGTATATATACATATATATATATAACATATATGGAAGAGGAAAAGGCTGGTACAACGGAGGCCTGCGACCCTGGGGGCACAGGAGGCAGGCATGGCCCTGGGCGGGGCGTGGGGGGGCGTGGAGGGAGGCCCCAGGGGGTCTCACCCATGCAAGCAGAGGACCAGGGCCTTTTCTGGCACCGCAGTTTTGTTTTAAAACTGGACCTGTATATTTGTAAAGCTATTTATGGGCCCCTGGCACTCTTGTTCCCACACCCCAACACTTCCAGCATTTAGCTGGCCACATGGCGGAGAGTTTTAATTTTTAACTTATTGACAACCGAGAAGGTTTATCCCGCCGATAGAGGGACGGCCAAGAATGTACGTCCAGCCTGCCCCGGAGCTGGAGGATCCCCTCCAAGCCTAAAAGGTTGTTAATAGTTGGAGGTGATTCCAGTGAAGATATTTTATTTCCTTTGTCCTTTTTCAGGAGAATTAGATTTCTATAGGATTTTTCTTTAGGAGATTTATTTTTTGGACTTCAAAGCAAGCTGGTATTTTCATACAAATTCTTCTAATTGCTGTGTGTCCCAGGCAGGGAGACGGTTTCCAGGGAGGGGCCGGCCCTGTGTGCAGGTTCCGATGTTATTAGATGTTACAAGTTTATATATATCTATATATATAATTTATTGAGTTTTTACAAGATGTATTTGTTGTAGACTTAACACTTCTTACGCAATGCTTCTAGAGTTTTATAGCCTGGACTGCTACCTTTCAAAGCTTGGAGGGAAGCCGTGAATTCAGTTGGTTCGTTCTGTACTGTTACTGGGCCCTGAGTCTGGGCAGCTGTCCCTTGCTTGCCTGCAGGGCCATGGCTCAGGGTGGTCTCTTCTTGGGGCCCAGTGCATGGTGGCCAGAGGTGTCACCCAAACCGGCAGGTGCGATTTTGTTAACCCAGCGACGAACTTTCCGAAAAATAAAGACACCTGGTTGCTAACCTGG

SEQ ID NO: 46 - protein, 694 aa, Homo sapiens
MGAPACALALCVAVAIVAGASSESLGTEQRVVGRAAEVPGPEPGQQEQLVFGSGDAVELSCPPPGGGPMGPTVWVKDGTGLVPSERVLVGPQRLQVLNASHEDSGAYSCRQRLTQRVLCHFSVRVTDAPSSGDDEDGEDEAEDTGVDTGAPYWTRPERMDKKLLAVPAANTVRFRCPAAGNPTPSISWLKNGREFRGEHRIGGIKLRHQQWSLVMESVVPSDRGNYTCVVENKFGSIRQTYTLDVLERSPHRPILQAGLPANQTAVLGSDVEFHCKVYSDAQPHIQWLKHVEVNGSKVGPDGTPYVTVLKVSLESNASMSSNTPLVRIARLSSGEGPTLANVSELELPADPKWELSRARLTLGKPLGEGCFGQVVMAEAIGIDKDRAAKPVTVAVKMLKDDATDKDLSDLVSEMEMMKMIGKHKNIINLLGACTQGGPLYVLVEYAAKGNLREFLRARRPPGLDYSFDTCKPPEEQLTFKDLVSCAYQVARGMEYLASQKCIHRDLAARNVLVTEDNVMKIADFGLARDVHNLDYYKKTTNGRLPVKWMAPEALFDRVYTHQSDVWSFGVLLWEIFTLGGSPYPGIPVEELFKLLKEGHRMDKPANCTHDLYMIMRECWHAAPSQRPTFKQLVEDLDRVLTVTSTDEYLDLSAPFEQYSPGGQDTPSSSSSGDDSVFAHDLLPPAPPSSGGSRT

SEQ ID NO: 47 - protein, 2184 aa, Homo sapiens
CGCGCGCTGCCTGAGGACGCCGCGGCCCCCGCCCCCGCCATGGGCGCCCCTGCCTGCGCCCTCGCGCTCTGCGTGGCCGTGGCCATCGTGGCCGGCGCCTCCTCGGAGTCCTTGGGGACGGAGCAGCGCGTCGTGGGGCGAGCGGCAGAAGTCCCGGGCCCAGAGCCCGGCCAGCAGGAGCAGTTGGTCTTCGGCAGCGGGGATGCTGTGGAGCTGAGCTGTCCCCCGCCCGGGGGTGGTCCCATGGGGCCCACTGTCTGGGTCAAGGATGGCACAGGGCTGGTGCCCTCGGAGCGTGTCCTGGTGGGGCCCCAGCGGCTGCAGGTGCTGAATGCCTCCCACGAGGACTCCGGGGCCTACAGCTGCCGGCAGCGGCTCACGCAGCGCGTACTGTGCCACTTCAGTGTGCGGGTGACAGACGCTCCATCCTCGGGAGATGACGAAGACGGGGAGGACGAGGCTGAGGACACAGGTGTGGACACAGGGGCCCCTTACTGGACACGGCCCGAGCGGATGGACAAGAAGCTGCTGGCCGTGCCGGCCGCCAACACCGTCCGCTTCCGCTGCCCAGCCGCTGGCAACCCCACTCCCTCCATCTCCTGGCTGAAGAACGGCAGGGAGTTCCGCGGCGAGCACCGCATTGGAGGCATCAAGCTGCGGCATCAGCAGTGGAGCCTGGTCATGGAAAGCGTGGTGCCCTCGGACCGCGGCAACTACACCTGCGTCGTGGAGAACAAGTTTGGCAGCATCCGGCAGACGTACACGCTGGACGTGCTGGAGCGCTCCCCGCACCGGCCCATCCTGCAGGCGGGGCTGCCGGCCAACCAGACGGCGGTGCTGGGCAGCGACGTGGAGTTCCACTGCAAGGTGTACAGTGACGCACAGCCCCACATCCAGTGGCTCAAGCACGTGGAGGTGAATGGCAGCAAGGTGGGCCCGGACGGCACACCCTACGTTACCGTGCTCAAGGTGTCCCTGGAGTCCAACGCGTCCATGAGCTCCAACACACCACTGGTGCGCATCGCAAGGCTGTCCTCAGGGGAGGGCCCCACGCTGGCCAATGTCTCCGAGCTCGAGCTGCCTGCCGACCCCAAATGGGAGCTGTCTCGGGCCCGGCTGACCCTGGGCAAGCCCCTTGGGGAGGGCTGCTTCGGCCAGGTGGTCATGGCGGAGGCCATCGGCATTGACAAGGACCGGGCCGCCAAGCCTGTCACCGTAGCCGTGAAGATGCTGAAAGACGATGCCACTGACAAGGACCTGTCGGACCTGGTGTCTGAGATGGAGATGATGAAGATGATCGGGAAACACAAAAACATCATCAACCTGCTGGGCGCCTGCACGCAGGGCGGGCCCCTGTACGTGCTGGTGGAGTACGCGGCCAAGGGTAACCTGCGGGAGTTTCTGCGGGCGCGGCGGCCCCCGGGCCTGGACTACTCCTTCGACACCTGCAAGCCGCCCGAGGAGCAGCTCACCTTCAAGGACCTGGTGTCCTGTGCCTACCAGGTGGCCCGGGGCATGGAGTACTTGGCCTCCCAGAAGTGCATCCACAGGGACCTGGCTGCCCGCAATGTGCTGGTGACCGAGGACAACGTGATGAAGATCGCAGACTTCGGGCTGGCCCGGGACGTGCACAACCTCGACTACTACAAGAAGACGACCAACGGCCGGCTGCCCGTGAAGTGGATGGCGCCTGAGGCCTTGTTTGACCGAGTCTACACTCACCAGAGTGACGTCTGGTCCTTTGGGGTCCTGCTCTGGGAGATCTTCACGCTGGGGGGCTCCCCGTACCCCGGCATCCCTGTGGAGGAGCTCTTCAAGCTGCTGAAGGAGGGCCACCGCATGGACAAGCCCGCCAACTGCACACACGACCTGTACATGATCATGCGGGAGTGCTGGCATGCCGCGCCCTCCCAGAGGCCCACCTTCAAGCAGCTGGTGGAGGACCTGGACCGTGTCCTTACCGTGACGTCCACCGACGAGTACCTGGACCTGTCGGCGCCTTTCGAGCAGTACTCCCCGGGTGGCCAGGACACCCCCAGCTCCAGCTCCTCAGGGGACGACTCCGTGTTTGCCCACGACCTGCTGCCCCCGGCCCCACCCAGCAGTGGGGGCTCGCGGACGTGAAGGGCCACTGGTCCCCAACAATGTGAGGGGTCCCTAGCAGCCCACCCTGCTGCTGGTGCA

SEQ ID NO: 48 - protein, 694 aa, Homo sapiens; identical to SEQ ID NO: 46

SEQ ID NO: 49 - protein, 3122 aa, Homo sapiens
CGCTCGCGGCCACGCCGCCGTCGCGGGTACATTCCTCGCTCCCGGCCGAGGAGCGCTCGGGCTGTCTGCGGACCCTGCCGCGTGCAGGGGTCGCGGCCGGCTGGAGCTGGGAGTGAGGCGGCGGAGGAGCCAGGTGAGGAGGAGCCAGGTGAGCAGGACCCTGTGCTGGGCGCGGAGTCACGCAGGCTCGAGGAAGGCAGTTGGTGGGAAGTCCAGCTTGGGTCCCTGAGAGCTGTGAGAAGGAGATGCGGCTGCTGCTGGCCCTGTTGGGGGTCCTGCTGAGTGTGCCTGGGCCTCCAGTCTTGTCCCTGGAGGCCTCTGAGGAAGTGGAGCTTGAGCCCTGCCTGGCTCCCAGCCTGGAGCAGCAAGAGCAGGAGCTGACAGTAGCCCTTGGGCAGCCTGTGCGTCTGTGCTGTGGGCGGGCTGAGCGTGGTGGCCACTGGTACAAGGAGGGCAGTCGCCTGGCACCTGCTGGCCGTGTACGGGGCTGGAGGGGCCGCCTAGAGATTGCCAGCTTCCTACCTGAGGATGCTGGCCGCTACCTCTGCCTGGCACGAGGCTCCATGATCGTCCTGCAGAATCTCACCTTGATTACAGGTGACTCCTTGACCTCCAGCAACGATGATGAGGACCCCAAGTCCCATAGGGACCCCTCGAATAGGCACAGTTACCCCCAGCAAGCACCCTACTGGACACACCCCCAGCGCATGGAGAAGAAACTGCATGCAGTACCTGCGGGGAACACCGTCAAGTTCCGCTGTCCAGCTGCAGGCAACCCCACGCCCACCATCCGCTGGCTTAAGGATGGACAGGCCTTTCATGGGGAGAACCGCATTGGAGGCATTCGGCTGCGCCATCAGCACTGGAGTCTCGTGATGGAGAGCGTGGTGCCCTCGGACCGCGGCACATACACCTGCCTGGTAGAGAACGCTGTGGGCAGCATCCGCTATAACTACCTGCTAGATGTGCTGGAGCGGTCCCCGCACCGGCCCATCCTGCAGGCCGGGCTCCCGGCCAACACCACAGCCGTGGTGGGCAGCGACGTGGAGCTGCTGTGCAAGGTGTACAGCGATGCCCAGCCCCACATCCAGTGGCTGAAGCACATCGTCATCAACGGCAGCAGCTTCGGAGCCGACGGTTTCCCCTATGTGCAAGTCCTAAAGACTGCAGACATCAATAGCTCAGAGGTGGAGGTCCTGTACCTGCGGAACGTGTCAGCCGAGGACGCAGGCGAGTACACCTGCCTCGCAGGCAATTCCATCGGCCTCTCCTACCAGTCTGCCTGGCTCACGGTGCTGCCAGAGGAGGACCCCACATGGACCGCAGCAGCGCCCGAGGCCAGGTATACGGACATCATCCTGTACGCGTCGGGCTCCCTGGCCTTGGCTGTGCTCCTGCTGCTGGCCGGGCTGTATCGAGGGCAGGCGCTCCACGGCCGGCACCCCCGCCCGCCCGCCACTGTGCAGAAGCTCTCCCGCTTCCCTCTGGCCCGACAGTTCTCCCTGGAGTCAGGCTCTTCCGGCAAGTCAAGCTCATCCCTGGTACGAGGCGTGCGTCTCTCCTCCAGCGGCCCCGCCTTGCTCGCCGGCCTCGTGAGTCTAGATCTACCTCTCGACCCACTATGGGAGTTCCCCCGGGACAGGCTGGTGCTTGGGAAGCCCCTAGGCGAGGGCTGCTTTGGCCAGGTAGTACGTGCAGAGGCCTTTGGCATGGACCCTGCCCGGCCTGACCAAGCCAGCACTGTGGCCGTCAAGATGCTCAAAGACAACGCCTCTGACAAGGACCTGGCCGACCTGGTCTCGGAGATGGAGGTGATGAAGCTGATCGGCCGACACAAGAACATCATCAACCTGCTTGGTGTCTGCACCCAGGAAGGGCCCCTGTACGTGATCGTGGAGTGCGCCGCCAAGGGAAACCTGCGGGAGTTCCTGCGGGCCCGGCGCCCCCCAGGCCCCGACCTCAGCCCCGACGGTCCTCGGAGCAGTGAGGGGCCGCTCTCCTTCCCAGTCCTGGTCTCCTGCGCCTACCAGGTGGCCCGAGGCATGCAGTATCTGGAGTCCCGGAAGTGTATCCACCGGGACCTGGCTGCCCGCAATGTGCTGGTGACTGAGGACAATGTGATGAAGATTGCTGACTTTGGGCTGGCCCGCGGCGTCCACCACATTGACTACTATAAGAAAACCAGCAACGGCCGCCTGCCTGTGAAGTGGATGGCGCCCGAGGCCTTGTTTGACCGGGTGTACACACACCAGAGTGACGTGTGGTCTTTTGGGATCCTGCTATGGGAGATCTTCACCCTCGGGGGCTCCCCGTATCCTGGCATCCCGGTGGAGGAGCTGTTCTCGCTGCTGCGGGAGGGACATCGGATGGACCGACCCCCACACTGCCCCCCAGAGCTGTACGGGCTGATGCGTGAGTGCTGGCACGCAGCGCCCTCCCAGAGGCCTACCTTCAAGCAGCTGGTGGAGGCGCTGGACAAGGTCCTGCTGGCCGTCTCTGAGGAGTACCTCGACCTCCGCCTGACCTTCGGACCCTATTCCCCCTCTGGTGGGGACGCCAGCAGCACCTGCTCCTCCAGCGATTCTGTCTTCAGCCACGACCCCCTGCCATTGGGATCCAGCTCCTTCCCCTTCGGGTCTGGGGTGCAGACATGAGCAAGGCTCAAGGCTGTGCAGGCACATAGGCTGGTGGCCTTGGGCCTTGGGGCTCAGCCACAGCCTGACACAGTGCTCGACCTTGATAGCATGGGGCCCCTGGCCCAGAGTTGCTGTGCCGTGTCCAAGGGCCGTGCCCTTGCCCTTGGAGCTGCCGTGCCTGTGTCCTGATGGCCCAAATGTCAGGGTTCTGCTCGGCTTCTTGGACCTTGGCGCTTAGTCCCCATCCCGGGTTTGGCTGAGCCTGGCTGGAGAGCTGCTATGCTAAACCTCCTGCCTCCCAATACCAGCAGGAGGTTCTGGGCCTCTGAACCCCCTTTCCCCACACCTCCCCCTGCTGCTGCTGCCCCAGCGTCTTGACGGGAGCATTGGCCCCTGAGCCCAGAGAAGCTGGAAGCCTGCCGAAAACAGGAGCAAATGGCGTTTTATAAATTATTTTTTTGAAATAAAGCTCTGTGTGCCTGGGTC

SEQ ID NO: 50 - protein, 802 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEARYTDIILYASGSLALAVLLLLAGLYRGQALHGRHPRPPATVQKLSRFPLARQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 51 - protein, 2733 aa, Homo sapiens
GTCGCGGGTACATTCCTCGCTCCCGGCCGAGGAGCGCTCGGGCTGTCTGCGGACCCTGCCGCGTGCAGGGGTCGCGGCCGGCTGGAGCTGGGAGTGAGGCGGCGGAGGAGCCAGGTGAGGAGGAGCCAGGAAGGCAGTTGGTGGGAAGTCCAGCTTGGGTCCCTGAGAGCTGTGAGAAGGAGATGCGGCTGCTGCTGGCCCTGTTGGGGGTCCTGCTGAGTGTGCCTGGGCCTCCAGTCTTGTCCCTGGAGGCCTCTGAGGAAGTGGAGCTTGAGCCCTGCCTGGCTCCCAGCCTGGAGCAGCAAGAGCAGGAGCTGACAGTAGCCCTTGGGCAGCCTGTGCGTCTGTGCTGTGGGCGGGCTGAGCGTGGTGGCCACTGGTACAAGGAGGGCAGTCGCCTGGCACCTGCTGGCCGTGTACGGGGCTGGAGGGGCCGCCTAGAGATTGCCAGCTTCCTACCTGAGGATGCTGGCCGCTACCTCTGCCTGGCACGAGGCTCCATGATCGTCCTGCAGAATCTCACCTTGATTACAGGTGACTCCTTGACCTCCAGCAACGATGATGAGGACCCCAAGTCCCATAGGGACCCCTCGAATAGGCACAGTTACCCCCAGCAAGCACCCTACTGGACACACCCCCAGCGCATGGAGAAGAAACTGCATGCAGTACCTGCGGGGAACACCGTCAAGTTCCGCTGTCCAGCTGCAGGCAACCCCACGCCCACCATCCGCTGGCTTAAGGATGGACAGGCCTTTCATGGGGAGAACCGCATTGGAGGCATTCGGCTGCGCCATCAGCACTGGAGTCTCGTGATGGAGAGCGTGGTGCCCTCGGACCGCGGCACATACACCTGCCTGGTAGAGAACGCTGTGGGCAGCATCCGCTATAACTACCTGCTAGATGTGCTGGAGCGGTCCCCGCACCGGCCCATCCTGCAGGCCGGGCTCCCGGCCAACACCACAGCCGTGGTGGGCAGCGACGTGGAGCTGCTGTGCAAGGTGTACAGCGATGCCCAGCCCCACATCCAGTGGCTGAAGCACATCGTCATCAACGGCAGCAGCTTCGGAGCCGACGGTTTCCCCTATGTGCAAGTCCTAAAGACTGCAGACATCAATAGCTCAGAGGTGGAGGTCCTGTACCTGCGGAACGTGTCAGCCGAGGACGCAGGCGAGTACACCTGCCTCGCAGGCAATTCCATCGGCCTCTCCTACCAGTCTGCCTGGCTCACGGTGCTGCCAGAGGAGGACCCCACATGGACCGCAGCAGCGCCCGAGGCCAGTTCTCCCTGGAGTCAGGCTCTTCCGGCAAGTCAAGCTCATCCCTGGTACGAGGCGTGCGTCTCTCCTCCAGCGGCCCCGCCTTGCTCGCCGGCCTCGCTGGTGCTTGGGAAGCCCCTAGGCGAGGGCTGCTTTGGCCAGGTAGTACGTGCAGAGGCCTTTGGCATGGACCCTGCCCGGCCTGACCAAGCCAGCACTGTGGCCGTCAAGATGCTCAAAGACAACGCCTCTGACAAGGACCTGGCCGACCTGGTCTCGGAGATGGAGGTGATGAAGCTGATCGGCCGACACAAGAACATCATCAACCTGCTTGGTGTCTGCACCCAGGAAGGGCCCCTGTACGTGATCGTGGAGTGCGCCGCCAAGGGAAACCTGCGGGAGTTCCTGCGGGCCCGGCGCCCCCCAGGCCCCGACCTCAGCCCCGACGGTCCTCGGAGCAGTGAGGGGCCGCTCTCCTTCCCAGTCCTGGTCTCCTGCGCCTACCAGGTGGCCCGAGGCATGCAGTATCTGGAGTCCCGGAAGTGTATCCACCGGGACCTGGCTGCCCGCAATGTGCTGGTGACTGAGGACAATGTGATGAAGATTGCTGACTTTGGGCTGGCCCGCGGCGTCCACCACATTGACTACTATAAGAAAACCAGCAACGGCCGCCTGCCTGTGAAGTGGATGGCGCCCGAGGCCTTGTTTGACCGGGTGTACACACACCAGAGTGACGTGTGGTCTTTTGGGATCCTGCTATGGGAGATCTTCACCCTCGGGGGCTCCCCGTATCCTGGCATCCCGGTGGAGGAGCTGTTCTCGCTGCTGCGGGAGGGACATCGGATGGACCGACCCCCACACTGCCCCCCAGAGCTGTACGGGCTGATGCGTGAGTGCTGGCACGCAGCGCCCTCCCAGAGGCCTACCTTCAAGCAGCTGGTGGAGGCGCTGGACAAGGTCCTGCTGGCCGTCTCTGAGGAGTACCTCGACCTCCGCCTGACCTTCGGACCCTATTCCCCCTCTGGTGGGGACGCCAGCAGCACCTGCTCCTCCAGCGATTCTGTCTTCAGCCACGACCCCCTGCCATTGGGATCCAGCTCCTTCCCCTTCGGGTCTGGGGTGCAGACATGAGCAAGGCTCAAGGCTGTGCAGGCACATAGGCTGGTGGCCTTGGGCCTTGGGGCTCAGCCACAGCCTGACACAGTGCTCGACCTTGATAGCATGGGGCCCCTGGCCCAGAGTTGCTGTGCCGTGTCCAAGGGCCGTGCCCTTGCCCTTGGAGCTGCCGTGCCTGTGTCCTGATGGCCCAAATGTCAGGGTTCTGCTCGGCTTCTTGGACCTTGGCGCTTAGTCCCCATCCCGGGTTTGGCTGAGCCTGGCTGGAGAGCTGCTATGCTAAACCTCCTGCCTCCCAATACCAGCAGGAGGTTCTGGGCCTCTGAACCCCCTTTCCCCACACCTCCCCCTGCTGCTGCTG

SEQ ID NO: 52 - protein, 734 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPEEDPTWTAAAPEASSPWSQALPASQAHPWYEACVSPPAAPPCSPASLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 53 - protein, 2638 aa, Homo sapiens
ACATTCCTCGCTCCCGGCCGAGGAGCGCTCGGGCTGTCTGCGGACCCTGCCGCGTGCAGGGGTCGCGGCCGGCTGGAGCTGGGAGTGAGGCGGCGGAGGAGCCAGGTGAGGAGGAGCCAGGAAGGCAGTTGGTGGGAAGTCCAGCTTGGGTCCCTGAGAGCTGTGAGAAGGAGATGCGGCTGCTGCTGGCCCTGTTGGGGGTCCTGCTGAGTGTGCCTGGGCCTCCAGTCTTGTCCCTGGAGGCCTCTGAGGAAGTGGAGCTTGAGCCCTGCCTGGCTCCCAGCCTGGAGCAGCAAGAGCAGGAGCTGACAGTAGCCCTTGGGCAGCCTGTGCGTCTGTGCTGTGGGCGGGCTGAGCGTGGTGGCCACTGGTACAAGGAGGGCAGTCGCCTGGCACCTGCTGGCCGTGTACGGGGCTGGAGGGGCCGCCTAGAGATTGCCAGCTTCCTACCTGAGGATGCTGGCCGCTACCTCTGCCTGGCACGAGGCTCCATGATCGTCCTGCAGAATCTCACCTTGATTACAGGTGACTCCTTGACCTCCAGCAACGATGATGAGGACCCCAAGTCCCATAGGGACCCCTCGAATAGGCACAGTTACCCCCAGCAAGCACCCTACTGGACACACCCCCAGCGCATGGAGAAGAAACTGCATGCAGTACCTGCGGGGAACACCGTCAAGTTCCGCTGTCCAGCTGCAGGCAACCCCACGCCCACCATCCGCTGGCTTAAGGATGGACAGGCCTTTCATGGGGAGAACCGCATTGGAGGCATTCGGCTGCGCCATCAGCACTGGAGTCTCGTGATGGAGAGCGTGGTGCCCTCGGACCGCGGCACATACACCTGCCTGGTAGAGAACGCTGTGGGCAGCATCCGCTATAACTACCTGCTAGATGTGCTGGAGCGGTCCCCGCACCGGCCCATCCTGCAGGCCGGGCTCCCGGCCAACACCACAGCCGTGGTGGGCAGCGACGTGGAGCTGCTGTGCAAGGTGTACAGCGATGCCCAGCCCCACATCCAGTGGCTGAAGCACATCGTCATCAACGGCAGCAGCTTCGGAGCCGACGGTTTCCCCTATGTGCAAGTCCTAAAGACTGCAGACATCAATAGCTCAGAGGTGGAGGTCCTGTACCTGCGGAACGTGTCAGCCGAGGACGCAGGCGAGTACACCTGCCTCGCAGGCAATTCCATCGGCCTCTCCTACCAGTCTGCCTGGCTCACGGTGCTGCCAGAGGAGGACCCCACATGGACCGCAGCAGCGCCCGAGGCCAGGTATACGGACATCATCCTGTACGCGTCGGGCTCCCTGGCCTTGGCTGTGCTCCTGCTGCTGGCCGGGCTGTATCGAGGGCAGGCGCTCCACGGCCGGCACCCCCGCCCGCCCGCCACTGTGCAGAAGCTCTCCCGCTTCCCTCTGGCCCGACAGTTCTCCCTGGAGTCAGGCTCTTCCGGCAAGTCAAGCTCATCCCTGGTACGAGGCGTGCGTCTCTCCTCCAGCGGCCCCGCCTTGCTCGCCGGCCTCGTGAGTCTAGATCTACCTCTCGACCCACTATGGGAGTTCCCCCGGGACAGGCTGGTGCTTGGGAAGCCCCTAGGCGAGGGCTGCTTTGGCCAGGTAGTACGTGCAGAGGCCTTTGGCATGGACCCTGCCCGGCCTGACCAAGCCAGCACTGTGGCCGTCAAGATGCTCAAAGACAACGCCTCTGACAAGGACCTGGCCGACCTGGTCTCGGAGATGGAGGTGATGAAGCTGATCGGCCGACACAAGAACATCATCAACCTGCTTGGTGTCTGCACCCAGGAAGGGCCCCTGTACGTGATCGTGGAGTGCGCCGCCAAGGGAAACCTGCGGGAGTTCCTGCGGGCCCGGCGCCCCCCAGGCCCCGACCTCAGCCCCGACGGTCCTCGGAGCAGTGAGGGGCCGCTCTCCTTCCCAGTCCTGGTCTCCTGCGCCTACCAGGTGGCCCGAGGCATGCAGTATCTGGAGTCCCGGAAGTGTATCCACCGGGACCTGGCTGCCCGCAATGTGCTGGTGACTGAGGACAATGTGATGAAGATTGCTGACTTTGGGCTGGCCCGCGGCGTCCACCACATTGACTACTATAAGAAAACCAGCAACGGCCGCCTGCCTGTGAAGTGGATGGCGCCCGAGGCCTTGTTTGACCGGGTGTACACACACCAGAGTGACGTGTGGTCTTTTGGGATCCTGCTATGGGAGATCTTCACCCTCGGGGGCTCCCCGTATCCTGGCATCCCGGTGGAGGAGCTGTTCTCGCTGCTGCGGGAGGGACATCGGATGGACCGACCCCCACACTGCCCCCCAGAGCTGTACGGGCTGATGCGTGAGTGCTGGCACGCAGCGCCCTCCCAGAGGCCTACCTTCAAGCAGCTGGTGGAGGCGCTGGACAAGGTCCTGCTGGCCGTCTCTGAGGAGTACCTCGACCTCCGCCTGACCTTCGGACCCTATTCCCCCTCTGGTGGGGACGCCAGCAGCACCTGCTCCTCCAGCGATTCTGTCTTCAGCCACGACCCCCTGCCATTGGGATCCAGCTCCTTCCCCTTCGGGTCTGGGGTGCAGACATGAGCAAGGCTCAAGGCTGTGCAGGCACATAGGCTGGTGGCCTTGGGCCTTGGGGCTCA

SEQ ID NO: 54 - protein, 802 aa, Homo sapiens; identical to SEQ ID NO: 50

SEQ ID NO: 55 - protein, 2418 aa, Homo sapiens
AGTCCAGCTTGGGTCCCTGAGAGCTGTGAGAAGGAGATGCGGCTGCTGCTGGCCCTGTTGGGGGTCCTGCTGAGTGTGCCTGGGCCTCCAGTCTTGTCCCTGGAGGCCTCTGAGGAAGTGGAGCTTGAGCCCTGCCTGGCTCCCAGCCTGGAGCAGCAAGAGCAGGAGCTGACAGTAGCCCTTGGGCAGCCTGTGCGTCTGTGCTGTGGGCGGGCTGAGCGTGGTGGCCACTGGTACAAGGAGGGCAGTCGCCTGGCACCTGCTGGCCGTGTACGGGGCTGGAGGGGCCGCCTAGAGATTGCCAGCTTCCTACCTGAGGATGCTGGCCGCTACCTCTGCCTGGCACGAGGCTCCATGATCGTCCTGCAGAATCTCACCTTGATTACAGGTGACTCCTTGACCTCCAGCAACGATGATGAGGACCCCAAGTCCCATAGGGACCCCTCGAATAGGCACAGTTACCCCCAGCAAGCACCCTACTGGACACACCCCCAGCGCATGGAGAAGAAACTGCATGCAGTACCTGCGGGGAACACCGTCAAGTTCCGCTGTCCAGCTGCAGGCAACCCCACGCCCACCATCCGCTGGCTTAAGGATGGACAGGCCTTTCATGGGGAGAACCGCATTGGAGGCATTCGGCTGCGCCATCAGCACTGGAGTCTCGTGATGGAGAGCGTGGTGCCCTCGGACCGCGGCACATACACCTGCCTGGTAGAGAACGCTGTGGGCAGCATCCGCTATAACTACCTGCTAGATGTGCTGGAGCGGTCCCCGCACCGGCCCATCCTGCAGGCCGGGCTCCCGGCCAACACCACAGCCGTGGTGGGCAGCGACGTGGAGCTGCTGTGCAAGGTGTACAGCGATGCCCAGCCCCACATCCAGTGGCTGAAGCACATCGTCATCAACGGCAGCAGCTTCGGAGCCGACGGTTTCCCCTATGTGCAAGTCCTAAAGACTGCAGACATCAATAGCTCAGAGGTGGAGGTCCTGTACCTGCGGAACGTGTCAGCCGAGGACGCAGGCGAGTACACCTGCCTCGCAGGCAATTCCATCGGCCTCTCCTACCAGTCTGCCTGGCTCACGGTGCTGCCAGGTACTGGGCGCATCCCCCACCTCACATGTGACAGCCTGACTCCAGCAGGCAGAACCAAGTCTCCCACTTTGCAGTTCTCCCTGGAGTCAGGCTCTTCCGGCAAGTCAAGCTCATCCCTGGTACGAGGCGTGCGTCTCTCCTCCAGCGGCCCCGCCTTGCTCGCCGGCCTCGTGAGTCTAGATCTACCTCTCGACCCACTATGGGAGTTCCCCCGGGACAGGCTGGTGCTTGGGAAGCCCCTAGGCGAGGGCTGCTTTGGCCAGGTAGTACGTGCAGAGGCCTTTGGCATGGACCCTGCCCGGCCTGACCAAGCCAGCACTGTGGCCGTCAAGATGCTCAAAGACAACGCCTCTGACAAGGACCTGGCCGACCTGGTCTCGGAGATGGAGGTGATGAAGCTGATCGGCCGACACAAGAACATCATCAACCTGCTTGGTGTCTGCACCCAGGAAGGGCCCCTGTACGTGATCGTGGAGTGCGCCGCCAAGGGAAACCTGCGGGAGTTCCTGCGGGCCCGGCGCCCCCCAGGCCCCGACCTCAGCCCCGACGGTCCTCGGAGCAGTGAGGGGCCGCTCTCCTTCCCAGTCCTGGTCTCCTGCGCCTACCAGGTGGCCCGAGGCATGCAGTATCTGGAGTCCCGGAAGTGTATCCACCGGGACCTGGCTGCCCGCAATGTGCTGGTGACTGAGGACAATGTGATGAAGATTGCTGACTTTGGGCTGGCCCGCGGCGTCCACCACATTGACTACTATAAGAAAACCAGCAACGGCCGCCTGCCTGTGAAGTGGATGGCGCCCGAGGCCTTGTTTGACCGGGTGTACACACACCAGAGTGACGTGTGGTCTTTTGGGATCCTGCTATGGGAGATCTTCACCCTCGGGGGCTCCCCGTATCCTGGCATCCCGGTGGAGGAGCTGTTCTCGCTGCTGCGGGAGGGACATCGGATGGACCGACCCCCACACTGCCCCCCAGAGCTGTACGGGCTGATGCGTGAGTGCTGGCACGCAGCGCCCTCCCAGAGGCCTACCTTCAAGCAGCTGGTGGAGGCGCTGGACAAGGTCCTGCTGGCCGTCTCTGAGGAGTACCTCGACCTCCGCCTGACCTTCGGACCCTATTCCCCCTCTGGTGGGGACGCCAGCAGCACCTGCTCCTCCAGCGATTCTGTCTTCAGCCACGACCCCCTGCCATTGGGATCCAGCTCCTTCCCCTTCGGGTCTGGGGTGCAGACATGAGCAAGGCTCAAGGCTGTGCAGGCACATAGGCTGGTGGCCTTGGGCCTTGGGGCTCAGCCACAGCCTGACACAGTGCTCGACCTTGATAGCATG

SEQ ID NO: 56 - protein, 762 aa, Homo sapiens
MRLLLALLGVLLSVPGPPVLSLEASEEVELEPCLAPSLEQQEQELTVALGQPVRLCCGRAERGGHWYKEGSRLAPAGRVRGWRGRLEIASFLPEDAGRYLCLARGSMIVLQNLTLITGDSLTSSNDDEDPKSHRDPSNRHSYPQQAPYWTHPQRMEKKLHAVPAGNTVKFRCPAAGNPTPTIRWLKDGQAFHGENRIGGIRLRHQHWSLVMESVVPSDRGTYTCLVENAVGSIRYNYLLDVLERSPHRPILQAGLPANTTAVVGSDVELLCKVYSDAQPHIQWLKHIVINGSSFGADGFPYVQVLKTADINSSEVEVLYLRNVSAEDAGEYTCLAGNSIGLSYQSAWLTVLPGTGRIPHLTCDSLTPAGRTKSPTLQFSLESGSSGKSSSSLVRGVRLSSSGPALLAGLVSLDLPLDPLWEFPRDRLVLGKPLGEGCFGQVVRAEAFGMDPARPDQASTVAVKMLKDNASDKDLADLVSEMEVMKLIGRHKNIINLLGVCTQEGPLYVIVECAAKGNLREFLRARRPPGPDLSPDGPRSSEGPLSFPVLVSCAYQVARGMQYLESRKCIHRDLAARNVLVTEDNVMKIADFGLARGVHHIDYYKKTSNGRLPVKWMAPEALFDRVYTHQSDVWSFGILLWEIFTLGGSPYPGIPVEELFSLLREGHRMDRPPHCPPELYGLMRECWHAAPSQRPTFKQLVEALDKVLLAVSEEYLDLRLTFGPYSPSGGDASSTCSSSDSVFSHDPLPLGSSSFPFGSGVQT

SEQ ID NO: 57 - protein, 11 aa, Homo sapiens
IVEYASKGNLR

SEQ ID NO: 58 - protein, 11 aa, Homo sapiens
IVEYASKGNLR

SEQ ID NO: 59 - protein, 11 aa, Homo sapiens
LVEYAAKGNLR

SEQ ID NO: 60 - protein, 11 aa, Homo sapiens
IVECAAKGNLR

What is claimed is:

1. A compound according to Formula (I)

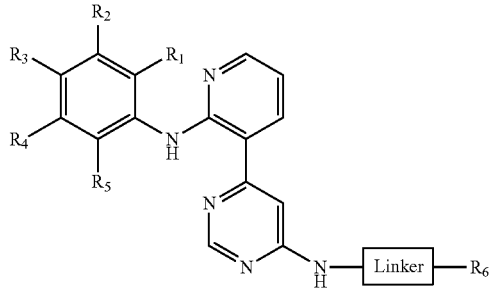

Formula (I)

or an optically pure stereoisomer, solvate, or pharmaceutically acceptable salt thereof, wherein each of $R_1$ and $R_5$ is Cl, each of $R_2$ and $R_4$ is OMe, and $R_3$ is H;

$R_6$ is NHCOCH=CH$_2$

Linker is selected from the group consisting of

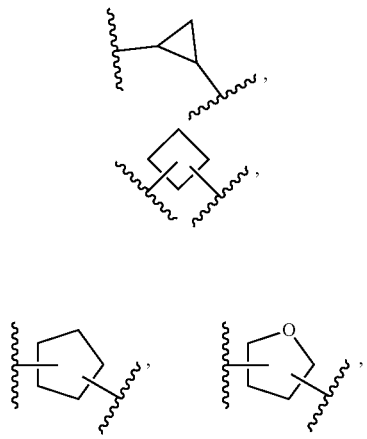

substituted phenyl, and

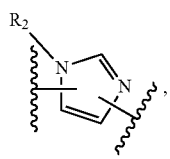

wherein said substituted phenyl comprises one or more substituents of the formula —O—(CH$_2$)$_n$—R$_8$;

n is an integer selected from 0 to 5;

$R_8$ is selected from the group consisting of

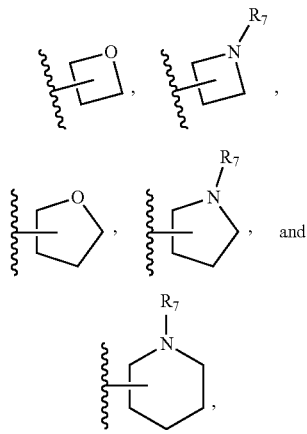

optionally substituted with one or more substituents selected from the group consisting of F, Cl, Br, $C_{1-4}$ alkyl, $CF_3$, $CHF_2$, and $NO_2$; and $R_7$ is selected from the group consisting of H, $C_{1-4}$ alkyl, and COC$_{1-4}$alkyl.

2. The compound of claim 1, wherein Linker is selected from the group consisting of

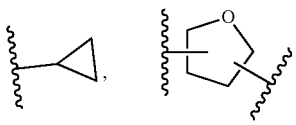

and substituted phenyl, wherein said substituted phenyl comprises one or more substituents of the formula —O—(CH$_2$)$_n$—R$_8$;

n is an integer selected from 0 to 2;

$R_8$ is selected from the group consisting of

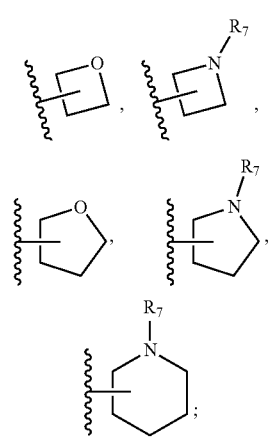

and $R_7$ is selected from the group consisting of H and $C_{1-4}$ alkyl.

3. A compound selected from the group consisting of
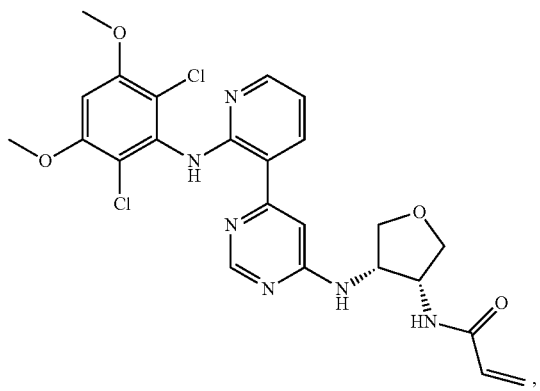
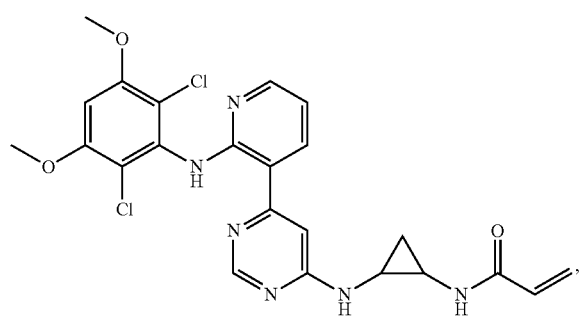
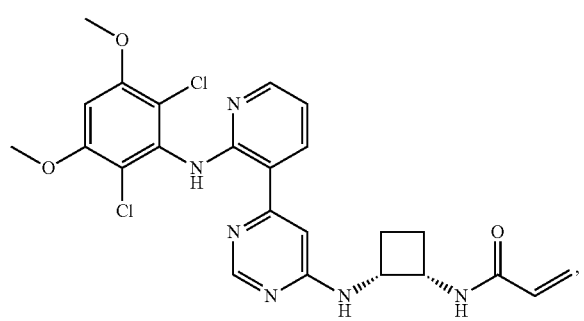
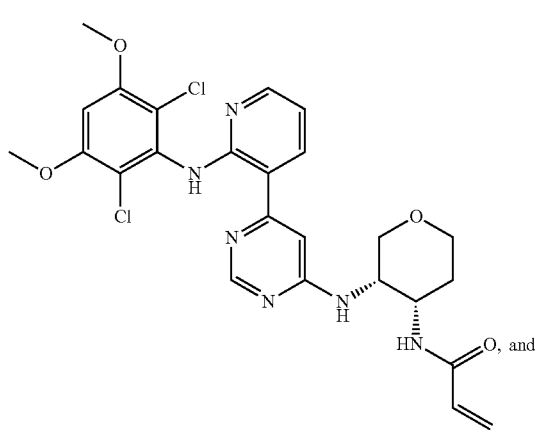
-continued
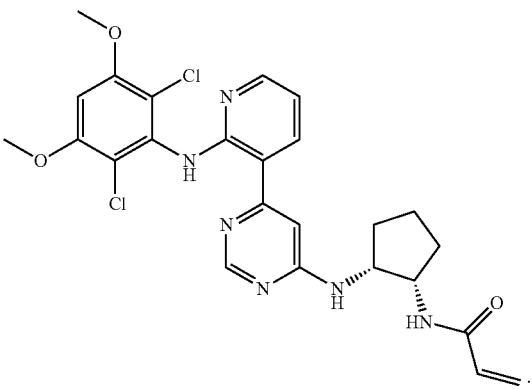
4. A compound selected from the group consisting of
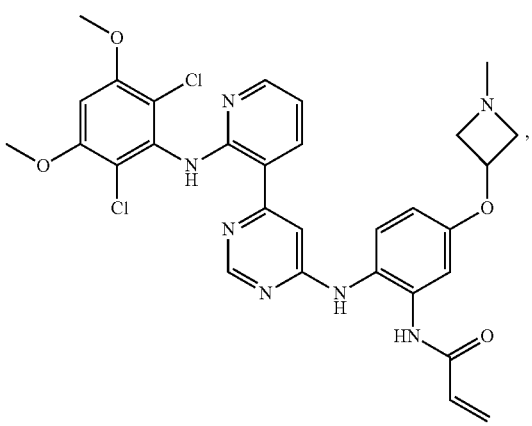
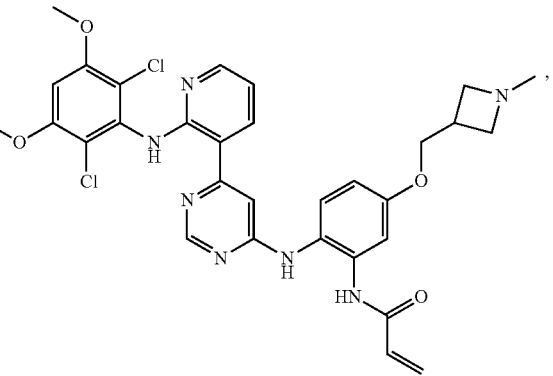
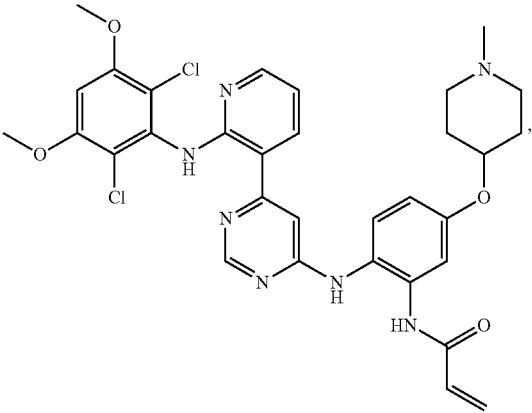

209
-continued

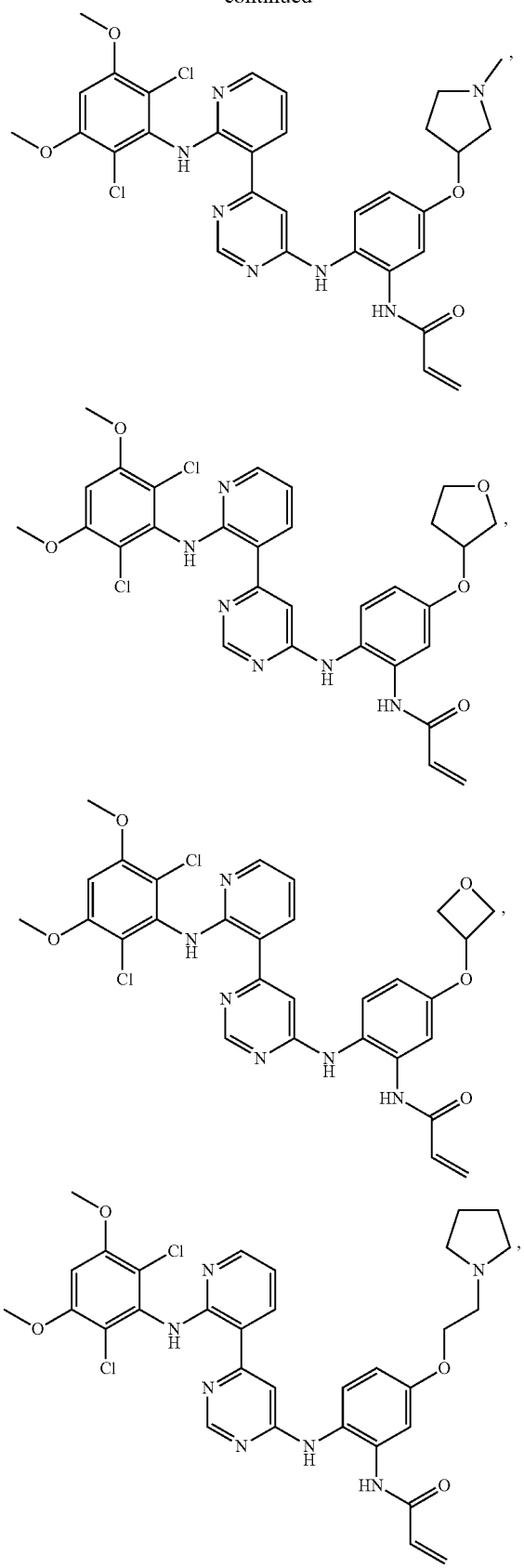

210
-continued

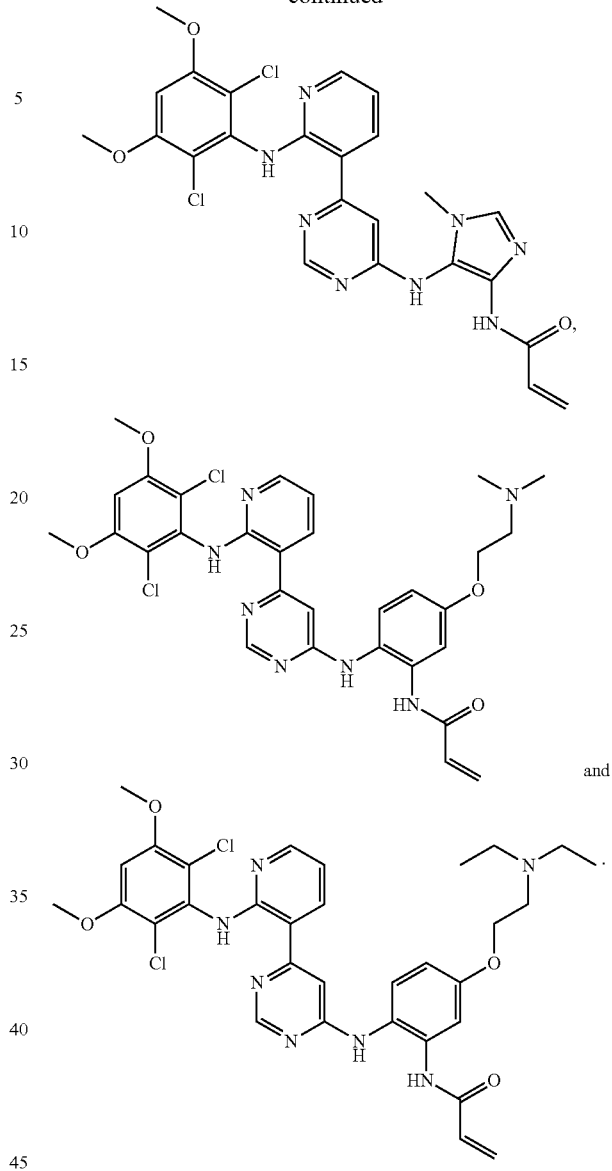

5. A pharmaceutical formulation comprising a compound according to any one of claims 1, 2, 3, and 4.

6. A method for treating cancer in a subject comprising administering a compound of claim 1 to the subject.

7. The method of claim 6, wherein the cancer is selected from the group consisting of breast, lung, bladder, prostate, ovarian, endometrial, rhabdomyosarcoma, liver, and gastric cancer.

8. The method of claim 7, further comprising administering a chemotherapeutic agent to the subject.

9. The method of claim 8, wherein the compound is administered prior to, simultaneously with, or following the administration of the chemotherapeutic agent.

10. A method for treating cancer in a subject comprising administering a compound of claim 2 to the subject.

11. A method for treating cancer in a subject comprising administering a compound of claim 3 to the subject.

12. A method for treating cancer in a subject comprising administering a compound of claim 4 to the subject.

* * * * *